(12) United States Patent
Conner et al.

(10) Patent No.: US 7,491,806 B2
(45) Date of Patent: Feb. 17, 2009

(54) NUCLEIC ACID MOLECULES AND OTHER MOLECULES ASSOCIATED WITH TRANSCRIPTION IN PLANTS

(75) Inventors: Timothy W. Conner, Wildwood, MO (US); Gregory R. Heck, Crystal Lake Park, MO (US); Jingdong Liu, Ballwin, MO (US)

(73) Assignee: Monsanto Technology, LLC, St. Louis, MO (US)

( * ) Notice: Subject to any disclaimer, the term of this patent is extended or adjusted under 35 U.S.C. 154(b) by 397 days.

(21) Appl. No.: 09/922,293

(22) Filed: Aug. 6, 2001

(65) Prior Publication Data
US 2004/0123339 A1    Jun. 24, 2004

Related U.S. Application Data

(63) Continuation of application No. 09/229,413, filed on Jan. 12, 1999, now abandoned, and a continuation of application No. 09/210,297, filed on Dec. 8, 1998, now abandoned, and a continuation of application No. 09/199,129, filed on Nov. 24, 1998.

(60) Provisional application No. 60/067,000, filed on Nov. 24, 1997, provisional application No. 60/069,472, filed on Dec. 9, 1997, provisional application No. 60/071,479, filed on Jan. 13, 1998, provisional application No. 60/074,201, filed on Feb. 10, 1998, provisional application No. 60/074,282, filed on Feb. 10, 1998, provisional application No. 60/074,280, filed on Feb. 10, 1998, provisional application No. 60/074,281, filed on Feb. 10, 1998, provisional application No. 60/074,566, filed on Feb. 12, 1998, provisional application No. 60/074,567, filed on Feb. 12, 1998, provisional application No. 60/074,565, filed on Feb. 12, 1998, provisional application No. 60/075,462, filed on Feb. 19, 1998, provisional application No. 60/074,789, filed on Feb. 19, 1998, provisional application No. 60/075,459, filed on Feb. 19, 1998, provisional application No. 60/075,461, filed on Feb. 19, 1998, provisional application No. 60/075,464, filed on Feb. 19, 1998, provisional application No. 60/075,460, filed on Feb. 19, 1998, provisional application No. 60/075,463, filed on Feb. 19, 1998, provisional application No. 60/077,231, filed on Mar. 9, 1998, provisional application No. 60/077,229, filed on Mar. 9, 1998, provisional application No. 60/077,230, filed on Mar. 9, 1998, provisional application No. 60/078,368, filed on Mar. 18, 1998, provisional application No. 60/080,844, filed on Apr. 7, 1998, provisional application No. 60/083,067, filed on Apr. 27, 1998, provisional application No. 60/083,386, filed on Apr. 29, 1998, provisional application No. 60/083,387, filed on Apr. 29, 1998, provisional application No. 60/083,388, filed on Apr. 29, 1998, provisional application No. 60/083,389, filed on Apr. 29, 1998, provisional application No. 60/085,224, filed on May 13, 1998, provisional application No. 60/085,223, filed on May 13, 1998, provisional application No. 60/085,222, filed on May 13, 1998, provisional application No. 60/085,533, filed on May 15, 1998, provisional application No. 60/086,186, filed on May 21, 1998, provisional application No. 60/086,187, filed on May 21, 1998, provisional application No. 60/086,185, filed on May 21, 1998, provisional application No. 60/086,184, filed on May 21, 1998, provisional application No. 60/086,183, filed on May 21, 1998, provisional application No. 60/086,188, filed on May 21, 1998, provisional application No. 60/089,524, filed on Jun. 16, 1998, provisional application No. 60/089,810, filed on Jun. 18, 1998, provisional application No. 60/089,814, filed on (Continued)

(51) Int. Cl.
*C07H 21/00*    (2006.01)
(52) U.S. Cl. .................. 536/23.1; 536/23.6; 536/24.1
(58) Field of Classification Search .................. 435/6; 536/23.1, 25.3
See application file for complete search history.

(56) References Cited

U.S. PATENT DOCUMENTS 6,410,826 B1 *   6/2002   Yanofsky et al. ............ 800/278

OTHER PUBLICATIONS

GenBank Accession No. D30807 (Mar. 8, 1995).*
Meinkoth et al. (Hybridization of nucleic acids immobilized on solid supports: Analytical Biochemistry, 1984, vol. 138, pp. 267-284).*

(Continued)

*Primary Examiner*—Lori A Clow
(74) *Attorney, Agent, or Firm*—Lawrence M. Lavin, Jr.; Matthew L. Madsen; Arnold & Porter LLP

(57) ABSTRACT

The present invention is in the field of plant biochemistry. More specifically the invention relates to nucleic acid sequences from plant cells, in particular, nucleic acid sequences from maize, soybean and *Arabidopsis thaliana* associated with transcription factors. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

10 Claims, No Drawings

Related U.S. Application Data

Jun. 18, 1998, provisional application No. 60/089,808, filed on Jun. 18, 1998, provisional application No. 60/089,812, filed on Jun. 18, 1998, provisional application No. 60/089,807, filed on Jun. 18, 1998, provisional application No. 60/089,806, filed on Jun. 18, 1998, provisional application No. 60/089,813, filed on Jun. 18, 1998, provisional application No. 60/089,811, filed on Jun. 18, 1998, provisional application No. 60/089,793, filed on Jun. 18, 1998, provisional application No. 60/091,405, filed on Jun. 30, 1998, provisional application No. 60/091,247, filed on Jun. 30, 1998, provisional application No. 60/099,667, filed on Sep. 9, 1998, provisional application No. 60/099,668, filed on Sep. 9, 1998, provisional application No. 60/099,670, filed on Sep. 9, 1998, provisional application No. 60/099,697, filed on Sep. 9, 1998, provisional application No. 60/100,674, filed on Sep. 16, 1998, provisional application No. 60/100,673, filed on Sep. 16, 1998, provisional application No. 60/100,672, filed on Sep. 16, 1998, provisional application No. 60/100,963, filed on Sep. 17, 1998, provisional application No. 60/101,131, filed on Sep. 21, 1998, provisional application No. 60/101,132, filed on Sep. 21, 1998, provisional application No. 60/101,130, filed on Sep. 21, 1998, provisional application No. 60/101,508, filed on Sep. 22, 1998, provisional application No. 60/101,344, filed on Sep. 22, 1998, provisional application No. 60/101,347, filed on Sep. 22, 1998, provisional application No. 60/101,343, filed on Sep. 22, 1998, provisional application No. 60/101,707, filed on Sep. 25, 1998, provisional application No. 60/104,126, filed on Oct. 13, 1998, provisional application No. 60/113,224, filed on Dec. 22, 1998, provisional application No. 60/104,128, filed on Oct. 13, 1998, provisional application No. 60/104,127, filed on Oct. 13, 1998, provisional application No. 60/104,124, filed on Oct. 13, 1998, provisional application No. 60/109,018, filed on Nov. 19, 1998, provisional application No. 60/108,996, filed on Nov. 18, 1998, provisional application No. 60/111,981, filed on Dec. 11, 1998.

(56) References Cited

OTHER PUBLICATIONS

Genebank Accession No. AB035137 (Aug. 9, 2000).*
Genebank Accession No. AF296825 (Aug. 23, 2000).*
Genebank Accession No. D30807 (Mar. 8, 1995).*
Genebank Accession No. AF115821 (Nov. 15, 1999).*
GeneBank Accession No. AA728430 (Jan. 5, 1998).*
Attwood (Science, 290:471-473, 2000).*
Gerhold et al. (BioEssays, 18(12):973-981, 1996).*
Wells et al. (Journal of Leukocyte Biology, 61(5):545-550, 1997).*
Russell et al. (Journal of Molecular Biology, 244:332-350, 1994).*
Bork et al. (1998) JMB 283 :707-725.*
Schena et al. PNAS (1994) vol. 91, pp. 8393-8397).*
Colasanti, et al., Entrez Accession AF058757, Jun. 5, 1998.
Colansanti, et al., Entrez Accession 3170601, Jun. 4, 1998.
Foley, et al., "Isolation of a Maize bZIP Protein Subfamily: Candidates for the ocs-element Transcription Factor", *The Plant Journal*, 3(5):669-679 (1993).
Freeling, et al., "Developmental Genetics of Mutants that Specify Knotted Leaves in Maize", *Genetics*, 111:617-634 (Nov. 1985).
Gasch, et al., "*Arabidopsis thaliana* Contains Two Genes for TFIID", *Nature* 346:390-394 (Jul. 1990).
Goodrich, et al., "A Polycomb-group Gene Regulates Homeotic Gene Expression in *Arabidopsis*", *Nature*, 386:44-51 (Mar. 1997).
Hancock, J., Evolution of Sequence Repetition and Gene Duplications in the TATA-binding Protein TBP (TFIID), *Nucleic Acids Research*, 21(12):2823-2830 (1993).
Hardin, et al., Entrez Accession U83625, Dec. 8, 1998.
Hardin, et al., Entrez Accession 2737973, Dec. 8, 1998.
Holdsworth, et al., "The Maize Transcription Factor Opaque-2 Activates a Wheat Glutenin Promoter in Plant and Yeast Cells", *Plant Molecular Biology* 29:711-720, (1995).
Jack, et al., "The Homeotic Gene APETALA3 of *Arabidopsis thaliana* Encodes a MADS Box and Is Expressed in Petals and Stamens", *Cell* 68:683-697 (Feb. 21, 1992).
Kawata, et al., "A cDNA Clone Encoding HBP-1b Homologue in *Arabidopsis thaliana*", *Nucleic Acids Research*, 20(5), 1141 (Mar. 11, 1992).
Laughner, et al., Entrez Accession 4056568, Dec. 1998.
Laughner, et al., Entrez Accession U90944, Dec. 1998.
Lincoln, et al., "A *knotted1*-like Homeobox Gene in *Arabidopsis* Is Expressed in the Vegetative Meristem and Dramatically Alters Leaf Morphology When Overexpressed in Transgenic Plants", *The Plant Cell*, 6:1859-1876 (Dec. 1994).
Martin, et al., "MYB Transcription Factors in Plants", *Trends in Genetics*, 13(2):67-73 (Feb. 1997).
Meyerowitz, E.M., "Genetic Control of Cell Division Patterns in Developing Plants", *Cell*, 88:299-308 (Feb. 7, 1997).
Moose, et al., "*Glossy15*, an APETALA2-like Gene From Maize That Regulates Leaf Epidermal Cell Identity", *Genes & Development* 10(23):3018-3027 (Dec. 1, 1996).
Muller, et al., "The Barley *Hooded* Mutation Caused By a Duplication in a Homeobox Gene Intron", *Nature*, 374(6524):727-730 (Apr. 20, 1995).
Noda, et al., "Flower Colour Intensity Depends on Specialized cell Shape Controlled by a Myb-related Transcription Factor", *Nature*, 369(6482):661-664 (Jun. 1994).
Pagliuca, Entrez Accession 3004880, Mar. 30, 1998.
Radicella, "Allelic Diversity of the Maize *B* Regulatory Gene: Different Leader and Promoter Sequences of two *B* Alleles Determine Distinct Tissue Specificities of Anthocyanin Production", *Genes & Development* 6(11):2152-2164 (Nov. 1992).
Reichmann, et al., "MADS Domain Proteins in Plant Development", *Biol. Chem.*, 378:1079-1101, (Oct. 1997).
Schindler, et al., "DNA Binding Site Preferences and Transcriptional Activation Properties of the *Arabidopsis* Transcription Factor GBF1", *The EMBO Journal* 11:(4)1275-1289 (Apr. 1992).
Schumacher, et al., "Murine Polycomb- and *Trithorax*-Group Genes Regulate Homeotic Pathways and Beyond", *Trend in Genetics*, 13(5):167-170 (May 1997).
Schwarz-Sommer, et al., "Characterization of the *Antirrhinum* Floral Homeotic MADS-box Gene *deficiens*: Evidence for DNA Binding and Autoregulation of its Persistent Expression Throughout Flower Development", *The EMBO Journal*, 11(1):251-263 (Jan. 1992).
Tabata, et al., "A Protein That Binds to a cis-Acting Element of Wheat Histone Genes Has a Leucine Zipper Motif", *Science*, 245:965-967 (Sep. 1, 1989).
Tonelli, C., Entrez Accession X67619, May 11, 1995.
Urao, et al., "An *Arabidopsis myb* Homolog Is Induced by Dehydration Stress and Its Gene Product Binds to the Conserved MYB Recognition Sequence", *The Plant Cell*, 5:1529-1539 (Nov. 1993).
Vincentz, M., et al., Entrez Accession X78287, Sep. 23, 1997.
Vincentz, M., et al., Entrez Accession 463212, Sep. 23, 1997.
Vollbrecht, et al., "The Development Gene *Knotted-1* is a Member of a Maize Homeobox Gene Family", *Nature*, 350(3615):241-243 (Mar. 21, 1991).
Walsh, et al., Entrez Accession AF036949, Feb. 12, 1998.
Walsh, et al., Entrez Accession 2865394, Feb. 11, 1998.
Wang, et al., "A Myb-Related Transcription Factor Is Involved in the Phytochrome Regulation of an *Arabidopsis Lhcb* Gene", *The Plant Cell*, 9(4):491-507 (Apr. 1997).
Yanofsky, et al., "The Protein Encoded by the *Arabidopsis* Homeotic Gene *Agamous* Resembles Transcription Factors", *Nature* 346(6279):35-39 (Jul. 5, 1990).

* cited by examiner

NUCLEIC ACID MOLECULES AND OTHER MOLECULES ASSOCIATED WITH TRANSCRIPTION IN PLANTS

CROSS-REFERENCE TO RELATED APPLICATIONS

This application is a continuation of U.S. patent application Ser. No. 09/229,413 filed Jan. 12, 1999, herein incorporated by reference. This application claims priority under 35 U.S.C. § 119(e) and/or 35 U.S.C. § 120 of applications No. 60/067,000 filed Nov. 24, 1997; No. 60/069,472 filed Dec. 9, 1997; No. 60/071,479 filed Jan. 13, 1998; No. 60/074,201 filed Feb. 10, 1998; No. 60/074,282 filed Feb. 10, 1998; No. 60/074,280 filed Feb. 10, 1998; No. 60/074,281 filed Feb. 10, 1998; No. 60/074,566 filed Feb. 12, 1998; No. 60/074,567 filed Feb. 12, 1998; No. 60/074,565 filed Feb. 12, 1998; No. 60/075,462 filed Feb. 19, 1998; No. 60/074,789 filed Feb. 19, 1998; No. 60/075,459 filed Feb. 19, 1998; No. 60/075,461 filed Feb. 19, 1998; No. 60/075,464 filed Feb. 19, 1998; No. 60/075,460 filed Feb. 19, 1998; No. 60/075,463 filed Feb. 19, 1998; No. 60/077,231 filed Mar. 9, 1998; No. 60/077,229 filed Mar. 9, 1998; No. 60/077,230 filed Mar. 9, 1998; No. 60/078,368 filed Mar. 18, 1998; No. 60/080,844 filed April 7, 1998; No. 60/083,067 filed Apr. 27, 1998; No. 60/083,386 filed Apr. 29, 1998; No. 60/083,387 filed Apr. 29, 1998; No. 60/083,388 filed Apr. 29, 1998; No. 60/083,389 filed Apr. 29, 1998; No. 60/085,224 filed May 13, 1998; No. 60/085,223 filed May 13, 1998; No. 60/085,222 filed May 13, 1998; No. 60/085,533 filed May 15, 1998; No. 60/086,186 filed May 21, 1998; No. 60/086,187 filed May 21, 1998; No. 60/086,185 filed May 21, 1998; No. 60/086,184 filed May 21, 1998; No. 60/086,183 filed May 21, 1998; No. 60/086,188 filed May 21, 1998; No. 60/089,524 filed Jun. 16, 1998; No. 60/089,810 filed Jun. 18, 1998; No. 60/089,814 filed Jun. 18, 1998; No. 60/089,808 filed Jun. 18, 1998; No. 60/089,812 filed Jun. 18, 1998; No. 60/089,807 filed Jun. 18, 1998; No. 60/089,806 filed Jun. 18, 1998; No. 60/089,813 filed Jun. 18, 1998; No. 60/089,811 filed Jun. 18, 1998; No. 60/089,793 filed Jun. 18, 1998; No. 60/091,405 filed Jun. 30, 1998; No. 60/091,247 filed Jun. 30, 1998; No. 60/099,667 filed Sep. 9, 1998; No. 60/099,668 filed Sep. 9, 1998; No. 60/099,670 filed Sep. 9, 1998; No. 60/099,697 filed Sep. 9, 1998; No. 60/100,674 filed Sep. 16, 1998; No. 60/100,673 filed Sep. 16, 1998; No. 60/100,672 filed Sep. 16, 1998; No. 60/100,963 filed Sep. 17, 1998; No. 60/101,131 filed Sep. 21, 1998; No. 60/101,132 filed Sep. 21, 1998; No. 60/101,130 filed Sep. 21, 1998; No. 60/101,508 filed Sep. 22, 1998; No. 60/101,344 filed Sep. 22, 1998; No. 60/101,347 filed Sep. 22, 1998; No. 60/101,343 filed Sep. 22, 1998; No. 60/101,707 filed Sep. 25, 1998; No. 60/104,126 filed Oct. 13, 1998; No. 60/104,128 filed Oct. 13, 1998; No. 60/104,127 filed Oct. 13, 1998; No. 60/104,124 filed Oct. 13, 1998; No. 60/109,018 filed Nov. 19, 1998; No. 60/108,996 filed Nov. 18, 1998; Ser. No. 09/199,129 filed Nov. 24, 1998; Ser. No. 09/210,297 filed Dec. 8, 1998, now abandoned; No. 60/111,981 filed Dec. 11, 1998; and No. 60/113,224 filed Dec. 22, 1998, all of which are herein incorporated by reference in their entirety.

INCORPORATION OF SEQUENCE LISTING

Two copies of the sequence listing (Copy 1 and Copy 2) and a computer readable form (CRF) of the sequence listing, all on CD-ROMs, each containing the file named 16517-235 seq listing.txt, which is 1,929,701 bytes (measured in MS-DOS) and created on Aug. 6, 2001, are herein incorporated by reference.

FIELD OF THE INVENTION

The present invention is in the field of plant biochemistry. More specifically the invention relates to nucleic acid sequences from plant cells, in particular, nucleic acid sequences from maize and soybean plants and *Arabidopsis thaliana* associated with transcription in plants. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

BACKGROUND OF THE INVENTION

I. Transcription Factors

Eukaryotic transcription utilizes three different RNA polymerases. RNA polymerase I is located in the nucleolus and catalyzes the synthesis of ribosomal RNA. RNA polymerase II and III are present in the nucleoplasm. DNA dependent RNA synthesis by RNA polymerase III transcription complexes is responsible for the transcription of the genes that encode small nuclear RNAs and transfer RNA. RNA polymerase II transcribes the majority of the nuclear structural genes which typically encode proteins (type II genes).

In higher eukaryotes type II gene expression is often regulated, at least in part, at the level of transcription. A typical type II gene has one or more regulatory regions which include a promoter and one or more structural regions which is transcribed into precursor and messenger RNA. Type II genes are characterized by an upstream promoter region. Such regions are typically found between the start of transcription and 2000 bases distal to that transcriptional start site. Different combinations of sequence motifs can be associated with the upstream promoter region. These sequence motifs are recognized by sequence specific DNA binding proteins (transcription factors).

The polypeptide chains of transcription factors are usually divided into two functionally different regions, one that specifically binds to nucleic acid molecules and another that is associated with the activation of transcription. These functions are often present on different domains.

Several distinct structural elements or DNA binding domains which allow the transcription factor to bind to DNA in a sequence specific manner have been identified (Branden and Tooze, *Introduction to Protein structure*, Garland Publishing, Inc., New York (1990), the entirety of which is herein incorporated by reference). These binding domains often range in size from approximately 20 residues to more than 80 residues. Many DNA binding domain exhibit one or another of the following structural motifs: the helix-turn-helix motif, the zinc finger motif, and the leucine zipper motif. Other structural motifs include: the helix-loop-helix motif the pou motif and the multi-cysteine zinc finger.

Two sequence motifs or cis elements, the TATA box and the CAAT box are located within the promoter region of most type II genes. An AT-rich sequence called a TATA box is located approximately 30 nucleotides upstream from the start of transcription and is reported to play a role in positioning the start of transcription. A TATA box binding protein or TFIID factor has been identified that binds to this region (Hancock, *Nucleic Acid Research* 21: 2823-2830 (1993), the entirety of which is herein incorporated by reference; Gasch et al., Nature 346: 390-394 (1990), the entirety of which is herein incorporated by reference)(the TFIID factor is also referred to as the TBP/TAF factors). It has been reported that binding of TFIID to the TATA box plays a role in the assembly of other transcription factors to form a complex capable of initiating transcription (Nakajima et al., *Mole. Cell. Biol.* 8: 4038-4040 (1988), the entirety of which is herein incorporated by reference; Van Dyke et al., *Science* 241: 1335-1338 (1988), the entirety of which is herein incorporated by reference; Buratowski et al., *Cell* 56: 549-561 1989), the entirety of which is herein incorporated by reference).

In addition to the TATA box sequence, a CAAT box sequence is usually located approximately 75 bases upstream of the start of transcription. A CAAT box sequence binds a number of proteins, some of which are expressed in all tissues while others are expressed in a tissue specific manner (Branden and Tooze, *Introduction to Protein Structure*, Garland Publishing, Inc., New York (1990). One example of a CAAT box binding protein is the protein referred to as the CAAT box binding protein (C/EBP).

The G-box is a cis-acting element found within the promoters of many plant genes where it mediates expression in response to a variety of different stimuli (Schindler et al., *EMBO J.* 11:1275-1289 (1992), the entirety of which is herein incorporated by reference). The G-box comprises a palindromic DNA motif (CACGTG) which is composed of two identical half sites (Donald et al., *EMBO J.* 9:1727-1735 (1990); Izawa et al., *J. Mol. Biol.* 230:1131-1144 (1993) Schindler et al., *Plant Cell* 4:1309-1319 (1992); Schindler et al., *EMBO J.* 11:1275-1289 (1992); Odea et al, *EMBO J.* 10:1793-1991 (1991) Weisshaar et al, *EMBO J.* 10:1777-1786 (1991); and Zhang et al., *Plant J.* 4:711-716 (1993), all of which are herein incorporated by reference in their entirety). Both half sites are involved in the binding of the bZIP protein, GBF1, a member of the family *Arabidopsis thaliana*. The bZIP protein has been characterized in at least 19 other plant species (Erlich et al., *Gene* 117:169-178 (1992); Foley et al., *Plant J.* 3: 669-679 (1993); Guiltinan et al., *Science* 250:267-271 (1990); Kawata et al., *Nucl. Acids Res.* 20:1141 (1992); Katagiri et al., *Nature* 340:727-730 (1989); Odea et al., *EMBO J.* 10:1793-1991 (1991); Pysh et al., *Plant Cell* 5:227-236 (1993); Schindler et al., *Plant Cell* 4:1309-1319 (1992); Schmidt et al., *Proc. Natl. Acad. Sci.* (USA) 87:46-50 (1990); Singh et al., *Plant Cell* 2: 891-903 (1990); Tabata et al, *EMBO J.* 10: 1459-1467 (1991); Tabata et al., *Science* 245:965-967 (1989); Weisshaar et al., *EMBO J.* 10:1777-1786 (1991); Zhang et al., *Plant J.* 4:711-716 (1993), all of which are herein incorporated by reference in their entirety). Each of these proteins recognizes DNA sequences that share the central core sequence ACGT. bZIP transcription factors are characterized by the presence of a basic domain and a leucine zipper.

Plant bZIP proteins have been shown to bind regulatory elements from a wide variety of inducible plant genes including those regulated by cell cycle, light, UV light, drought and pathogen infections (Ehrlich et al., *Gene* 117: 169-178 (1992), Donald et al., *EMBO J.* 9:1727-1735 (1990); Guiltinan et al., *Science* 250:267-271 (1990); Katagiri et al., *Nature* 340:727-730 (1989); Oeda et al, *EMBO J.* 10: 1793-1991 (1991), the entirety of which is herein incorporated by reference; Tabata et al., *EMBO J.* 10:1459-1467 (1991); Weisshaar et al., *EMBO J.* 10:1777-1786 (1991); Holdworth et al., *Plant Molecular Biology* 29: 711-720 (1995), the entirety of which is herein incorporated by reference; Mikami et al., *Mol. Gen. Genet.* 248: 573-582 (1995), the entirety of which is herein incorporated by reference).

Specific transcription factors contribute to the quantitative and qualitative gene expression within a cell. The activity of a given transcription factors can effect cell physiology, metabolism, and/or the cell's ability to differentiate and communicate or associate with other cells within an organism. The regulation of the transcription of a gene may be the result of the activity of one or more transcription factors. Transcription factors are involved in the regulation of constitutive expression, inducible expression (such as expression in response to an environmental stimuli), and developmentally regulated expression.

Transcription factor gene families have been reported in plants (Martin and Paz-Ares, *Trends in Genetics* 13: 43-84 (1997), the entirety of which is herein incorporated by reference; Riechmann and Meyerowitz, *Bio. Chem.* 378: 1079-1101 (1997), the entirety of which is herein incorporated by reference). The MADS-box transcription factor family is one example of a transcription factor gene family found in plants as well as other organisms (Riechmann and Meyerowitz, *Bio. Chem.* 378: 1079-1101 (1997); Noda et al., *Nature* 369: 661-664 (1994), the entirety of which is herein incorporated by reference; Schwarz-Sommer et al., *EMBO J.* 11: 251-263 (1992), the entirety of which is herein incorporated by reference; Yanofsky et al., *Nature* 346: 35-39 (1990), the entirety of which is herein incorporated by reference; Drews et al., *Cell* 65: 991-1002 (1991), the entirety of which is herein incorporated by reference; Mizukami and Ma, *Cell* 71: 119-131 (1992), the entirety of which is herein incorporated by reference; Mandal et al, *Nature* 360: 273-277 (1992), the entirety of which is herein incorporated by reference; Gustafson-Brown et al, *Cell* 76: 131-143 (1994), the entirety of which is herein incorporated by reference; Jack et al, *Cell* 68: 703-716 (1992), the entirety of which is herein incorporated by reference; Goto and Meyerowitz, *Genes and Development* 8: 1548-1560 (1994), the entirety of which is herein incorporated by reference; Kriek and Meyerowitz, *Development* 122: 11-22 (1996), the entirety of which is herein incorporated by reference; Kempin et al, *Science* 267: 522-525 (1995), the entirety of which is herein incorporated by reference; Ma et al, *Genes and Development* 5: 484-495 (1991), the entirety of which is herein incorporated by reference; Flanagan et al, *Plant J.* 10: 343-353 (1996), the entirety of which is herein incorporated by reference; Flanagan and Ma, *Plant Mol. Biol.* 26: 581-595 (1994), the entirety of which is herein incorporated by reference; Huang et al, *Plant Cell* 8: 81-94 (1995), the entirety of which is herein incorporated by reference; Savidge et al, *Plant Cell* 7: 721-733 (1995), the entirety of which is herein incorporated by reference; Mandal and Yanofsky, *Plant Cell* 7: 1763-1771 (1995), the entirety of which is herein incorporated by reference; Roundsley et al, *Plant Cell* 7: 1259-1269 (1995), the entirety of which is herein incorporated by reference; Heck et al., *Plant Cell* 7: 1271-1282 (1995), the entirety of which is herein incorporated by reference; Perry et al., *Plant Cell* 8: 1977-1989 (1996), the entirety of which is herein incorporated by reference; Bradley et al., *Cell* 72: 85-95 (1993), the entirety of which is herein incorporated by reference; Huijser et al., *EMBO J.* 11: 1239-1249 (1992), the entirety of which is herein incorporated by reference; Sommer et al., *EMBO J.* 9: 605-613 (1990), the entirety of which is herein incorporated by reference; Trober et al., *EMBO J.* 11: 4693-4704 (1992), the entirety of which is herein incorporated by reference; Schwarz-Sommer et al., *EMBO J.* 11: 251-263 (1992), the entirety of which is herein incorporated by reference; Davies et al., *EMBO J.* 15: 4330-4343 (1996), the entirety of which is herein incorporated by reference; Zachgo et al., *Development* 121: 2861-2875 (1995), the entirety of which is herein incorporated by reference; Tsuchimoto et al., *Plant Cell* 5: 843-853 (1993), the entirety of which is herein incorporated by reference; Angenent et al., *Plant J.* 5: 33-44 (1993), the entirety of which is herein incorporated by reference; Van der Krol et al., *Genes and Development* 7: 1214-1228 (1993), the entirety of which is herein incorporated by reference; Angenent et al, *Plant Cell* 7: 505-516 (1995), the entirety of which is herein incorporated by reference; Angenent et al., *Plant Cell* 4: 983-993 (1992), the entirety of which is herein incorporated by reference; Angenent et al., *Plant J.* 5: 33-44 (1994), the entirety of which is herein incorporated by reference; Angenent et al., *Plant J.* 4: 101-112 (1993), the entirety of which is herein incorporated by reference; Angenent et al., *Plant Cell* 7: 1569-1582 (1995), the entirety of which is herein incorporated by reference; Columbo et al., *Plant Cell* 7: 1859-1868 (1995), the entirety of which is herein incorporated by reference ).

MADS-box transcription factors have been shown to bind to DNA and alter transcription by both induction and repression. Examples are known where MADS-box transcription factors exert their transcriptional regulation by binding and interacting individually, as homodimers or heterodimers, or through heterologous associations with non-MADS-box transcription factors. However, MADS transcription factors typically form dimers (Riechmann and Meyerowitz, *Bio. Chem.* 378: 1079-1101 (1997). MADS box transcription factors are defined by the signature MADS domain which is the most highly conserved portion of the protein among all the family members. In plants, additional domains (the I region, K-domain, and C-terminal region, in linear order) have been reported which are characteristic of the plant specific branch of this family.

The MADS domain is an approximately 57 amino acid domain located at or near the N-terminal portion of the MADS-box transcription factor (with approximately 260 amino acids in the total protein). This domain is highly conserved and is the most uniquely defining element of the family. For example, two homologues, APETALA1 from *Arabidopsis* and ZAP1 from *Zea mays*, show 89% identity over MADS domain. Conservation of this domain may be linked to its function as the portion of the protein that directly interacts with the target DNA binding site. The MADS domain is responsible for specifically binding DNA at A-T rich sequences referred to as CArG-boxes, whose consensus sequence has been reported as $CC(A/T)_6GG$ (Shore and Sharrocks, *Eur. J. Bioiochem.* 229: 1-13 (1995), the entirety of which is herein incorporated by reference).

The I domain spans approximately 30 amino acid sequence of poor sequence conservation compared to the MADS-domain. The intervening-region links the MADS domain region with the K-domain. Its length and sequence is variable and may be absent from some family members.

The K domain is an approximately 70 amino acid domain that is unique to the plant family members of the MADS-box gene superfamily. It is found in the majority of plant MADS-box genes. It has weak similarity to portions of animal keratin and is predicted to form amphipathic alpha helices which may facilitate interaction with other proteins. It has been reported that the structural conformation of this domain is a contributing constraint on conservation of this sequence. The K-domain typically exhibits less overall amino acid conservation than the MADS-domain, but between homologue genes such as APETALA1 from *Arabidopsis* and ZAP1 from *Zea mays*, this similarity can still be high (approximately 70%).

The C terminal domain, along with the I-domain, is the least conserved portions of the MADS-box gene family member in plants. Although exact functions for this approximately 90-100 amino acid domain have not been determined, there are known mutations within this region that lead to distinct developmental abnormalities in plants which indicate a role in transcriptional regulation. Conservation of this domain increases with increasing evolutionary closeness of species and homologues under comparison.

Genetic and molecular analysis have shown that transcription factors belonging to the MADS transcription factor family, at least in part, regulate diverse functions (Riechmann and Meyerowitz, *Bio. Chem.* 378: 1079-1101 (1997). MADS transcription factors often exert their effect in a homeotic manner (e.g. loss of AG activity (a MADS transcription factor) in *Arabidopsis* homeotically transforms the third and fourth whorl organs and eliminates floral determinacy) (Mena et al., *Science* 274: 1537-1540 (1996), the entirety of which is herein incorporated by reference). MADS transcription factors can regulate different processes. For example, the role of certain MADS transcription factors in floral development is reviewed in Riechmann and Meyerowitz, *Bio. Chem.* 378: 1079-1101 (1997). MADS transcription factors are also involved in the regulation of other plant processes such as phytochrome regulation (Wang et al., *Plant Cell* 9: 491-507 (1997), the entirety of which is herein incorporated by reference) and seed development (Colombo et al., *Plant Cell* 9: 703-715 (1997), the entirety of which is herein incorporated by reference).

Another family of transcription factors found in plants are MYB transcription factors. MYB transcription factors generally contain three repeats (R1, R2 and R3). The MYB DNA binding domain of plant proteins usually consists of two imperfect repeats of about 50 residues (Baranowskij et al., *EMBO J.* 13: 5383-5392 (1994), the entirety of which is herein incorporated by reference). MYB transcription factors exhibit a helix-turn-helix motif (Ogata et al., *Cell* 79: 639-648 (1994), the entirety of which is herein incorporated by reference). The DNA binding specificity of plant MYB proteins differs. For example, the maize P protein recognizes the motif [C/A]TCC[T/A]ACC similar to that bound by AmMYB305 from *Antirhinum*, and neither of these proteins appears to bind to the similar vertebrate MYB consensus motif (TAACNG) (Grotewold et al., *Cell* 76: 543-553 (1994), the entirety of which is herein incorporated by reference; Solano et al., *EMBO J.* 14: 1773-1784 (1995), the entirety of which is herein incorporated by reference). Small changes in the amino acid sequence of a MYB transcription factor can alter the DNA binding properties of that transcription factor. For example, PMYB3 from *Petunia* binds to two sequences, MBSI (TAAC[C/G] GTT) and MBSII (TAACTAAG) (Solano et al., *EMBO J.* 14: 1773-1784 (1995)). In the case of PMYB3, it has been shown that a substitution of a single residue in the R2 recognition helix switches the dual DNA-binding specificity to that of c-MYB, and the reciprocal substitution in c-MYB gives dual DNA-binding specificity similar to PhMYB3.

Mutations in residues that do not contact bases may also effect sequence-specific binding and have been reported to account for some of the differences in DNA-binding specificity between plant MYB proteins (Suzuki, *Proc Jap. Acad. Series B* 71: 27-31 (1995), the entirety of which is herein incorporated by reference). Of the eight putative base-contacting residues in MYB proteins, six are fully conserved in all plant MYB proteins, and the remaining two are conserved in at least 80% of these proteins. Nonetheless MYB transcription factors exhibit different nucleic acid sequence specificities and different strengths of contacts (Solano et al., *Plant J.* 8: 673-682 (1995), the entirety of which is herein incorporated by reference). In addition, temporal patterns of accumulation of RNA of different plant MYB genes may be effected by environmental stimuli, such as light, salt stress or the plant hormones, gibberellic acid and abscisic acid (Urao et al., *Plant Cell* 5: 1529-1539 (1993); Jackson et al., *Plant Cell* 3: 115-125 (1991), the entirety of which is herein incorporated by reference; Cone et al., *Plant Cell* 5: 1795-1805 (1993), the entirety of which is herein incorporated by reference; Noda et al., *Nature* 369: 661-664 (1994); Larkin et al., *Plant Cell* 5: 1739-1748 (1993), the entirety of which is herein incorporated by reference; Gubler et al., *Plant Cell* 7: 1879-1891 (1995), the entirety of which is herein incorporated by reference; Hattari et al., *Genes Dev.* 6: 609-618 (1992), the entirety of which is herein incorporated by reference).

In plants distinct functions for different MYB transcription factors have been reported including controlling secondary metabolism, regulation of cellular morphogenesis and the signal transduction pathways. MYB proteins are reported to play a role in the control of phenylpropanoid metabolism. Phenylpropanoid metabolism is one of the three main types of secondary metabolism in plants involving modification of compounds derived initially from phenylalanine. Through one branch (flavonoid metabolism) it is responsible for the production of a majority group of plant pigments (the anthocyanins) and other minor groups (aurones and phlobaphenes) and it also produces compounds that modify pigmentation through chemical interaction with the anthocyanins (co-pigmentation), such as the flavones and flavonols. Flavones and flavonols also serve to absorb ultraviolet light to protect plants. Several flavanoids act as signalling molecules in legumes inducing gene expression in symbiotic bacteria in a species-specific manner, and others act as factors required for pollen maturation and pollen germination in some plant species. A number of flavanoids and related phenylpropanoids (such as stilbenes) also act as defensive agents (phytoallexins) against biotic and abiotic stresses in particular plant species. Another branch of phenylpropanoid metabolism produces the precursors for production of lignin, the strengthening and waterproofing material of plant vascular tissue and one of the principal components of wood. This branch also produces other soluble phenolics, which can serve as signalling molecules, cell-wall crosslinking agents and antioxidants.

The C1 transcription factor (a MYB transcription factor) activates transcription of genes encoding enzymes involved in the biosynthesis of the anthocyanin pigments in the outer layer of cells of the maize seed endosperm (the aleurone) (Paz-Ares et al., *EMBO J.* 5: 829-833 (1986) Cone et al., *Proc. Natl. Acad Sci.* (*U.S.A.*) 83: 9631-9635 (1986), both of which are herein incorporated by reference in their entirety). Activation has been reported for at least five genes in the pathway to anthocyanin. Activation by C1 involves a partner transcriptional activator found in aleurone, a protein similar to a MYB transcription factor. These proteins also interact with other members of the R-protein family to regulate anthocyanin biosynthetic gene expression (Cone et al., *Plant Cell* 5: 1795-1805 (1993)). For example, in maize, another MYB protein, ZmMYB1, can activate one of the structural genes required for anthocyanin production (Franken et al., *Plant J.* 6: 21-30 (1994), the entirety of which is herein incorporated by reference), while yet another, ZmMYB38, inhibits C1-mediated activation of the same promoter.

Reiteration of MYB-gene function reportedly occurs in the control of a branch of flavonoid metabolism producing the red phlobaphene pigments from intermediates in flavonoid metabolism. This pathway is under control of the P gene in maize, which encodes a MYB-related protein (Grotewold et al., *Cell* 76: 543-553 (1994)). The P gene product activates a subset of the genes involved in anthocyanin biosynthesis. The P-binding site is contained within the promoters of these target genes (Li and Parish, *Plant J.* 8: 963-972 (1995), the entirety of which is herein incorporated by reference). In maize, at least two different MYB proteins serve to direct flavonoid metabolism along different routes by selective activation of target genes.

In other plant species MYB proteins can serve similar roles in the control of phenylpropanoid metabolism as, for example, in *Petunia* flowers. MYB proteins can also serve to regulate other branches of phenylpropanoid metabolism. In *Antirrhinum majus* and tobacco AmMYB305 (or its homologue in tobacco) can activate the gene encoding the first enzyme of phenylpropanoid metabolism, phenylalanine ammonia lyase (PAL (Urao et al., *Plant Cell* 5: 1529-1539 (1993)). Some MYB genes have been shown to be highly expressed in tissues such as differentiating xylem and may act to influence the branch of phenylpropanoid metabolism involved in lignin production (Campbell et al., *Plant Physiol.* 108 (Suppl.), 28 (1995), the entirety of which is herein incorporated by reference).

A second reported role for plant MYB genes is in the control of cell shape. For example, the MIXTA gene of *Antirrhinum* and the homologue PhMYB1 gene from *Petunia* have been shown to play a role in the development of the conical form of petal epidermal cells and the GL1 gene of *Arabidopsis* has been shown to be essential for the differentiation of hair cells (trichomes) in some parts of the leaf and in the stem (Noda et al., *Nature* 369: 661-664 (1994); Oppenheimer et al., *Cell* 67: 483-493 (1991), the entirety of which is herein incorporated by reference; Mur, PhD Thesis, Vrije Univ. of Amsterdam (1995), the entirety of which is herein incorporated by reference). Overexpression of MIXTA in transgenic tobacco results in trichome formation on pedals, suggesting that conical petal cells might be 'trichoblasts' arrested at an early stage in trichome formation.

GLI of *Arabidopsis* is associated with the expansion in the size of the cell that develops into the trichome, and it acts upstream of a number of other genes (Huilskamp et al., *Cell* 76: 555-566 (1994), the entirety of which is herein incorporated by reference). GLI mutants can exhibit cellular outgrowths that do not develop into full branched trichomes. GL2 of *Arabidopsis* encodes a homeodomain protein that is associated with chome development (Rerie et al., *Genes Dev.* 8: 1388-1399 (1994), the entirety of which is herein incorporated by reference). The GL2 gene promoter contains motifs very similar to the binding sites of P and AmMYB305 transcription factors (Rerie et al., *Genes Dev.* 8: 1388-1399 (1994)).

The conical cells produced by the action of the MIXTA gene of *Antirrhinum* resemble the limited outgrowths produced in *Arabidopsis* g12 mutants where trichome formation is aborted. In its regulation of trichome formation, GL1 interacts with the product of the TTG gene, which is required for trichome formation and anthocyanin production (Lloyd et al., *Science* 258: 1773-1775 (1992), the entirety of which is herein incorporated by reference). Expression of the maize R gene complements the ttg mutation and it has been reported that the TTG gene product is also a R-related protein that interacts with GL1 in a matter analogous to the interaction of C1 and R in maize (Lloyd et al., *Science* 258: 1773-1775 (1992)).

A further reported role for plant MYB proteins is in hormonal responses during seed development and germination. A barley MYB protein (GAMY) whose expression is induced by gibberellic acid (GA) has been shown to activate expression of a gene encoding a high pI α-amylase that is synthesized in barley aleurone upon germination for the mobilization of starch in the endosperm (Larkin et al., *Plant Cell* 5: 1739-1748 (1993). Expression of GAMYB is induced by treatment of aleurone layers with GA and expression of the α-amylase gene is induced subsequently. There is a suggestion that other GA-inducible genes can also respond to activation by MYB proteins during seed germination because MYB-like motifs from other GA-responsive gene promoters have been shown to direct reporter gene expression in response to GA (Larkin et al., *Plant Cell* 5: 1739-1748 (1993)). In addition, some MYB genes are expressed in response to GA treatment of *Petunia* petals (Mur, Ph.D.Thesis, Vrije Univ. of Amsterdam (1995)).

Treatment with another plant hormone, abscisic acid (ABA), induces expression of AtMYB2 in *Arabidopsis*, a MYB gene that is also induced in response to dehydration or salt stress (Shinozaki et al., *Plant Mol.* 19: 439-499 (1992), the entirety of which is herein incorporated by reference). In maize, expression of the C1 gene is also ABA-responsive, where it is involved in the formation of anthocyanin in the developing kernels (Larkin et al., *Plant Cell* 5: 1739-1748 (1993)). The rd22 gene promoter contains MYC-recognition sequences suggesting that AtMYB2 can interact with a bHLH protein to induce gene transcription in response to dehydration or salt stress (Iwasaki et al., *Mol. Gen. Genet.* 247: 391-398 (1995), the entirety of which is herein incorporated by reference).

Plant transcription factors that fall within the helix-loop-helix class of transcription factors have been reported. These include the transcription factor encoded by the *Zea mays* R and B class gene (Radicella et al., *Genes and Development* 6: 2152-2164 (1992), the entirety of which is herein incorporated by reference). Alleles that have been identified at the b and r loci show differences in developmental or tissue specific expression.

Homeodomain transcription factors have been isolated from different plant species (Ma et al., *Plant. Molec. Biol.* 24: 465-473 (1994), the entirety of which is herein incorporated by reference; Muller et al., *Nature* 374: 727 (1995), the entirety of which is herein incorporated by reference; Lincoln et al., *Plant Cell* 6: 1859-1876 (1994), entirety of which is herein incorporated by reference; Hareven et al., *Cell* 84: 735-744 (1996), entirety of which is herein incorporated by reference; Vollbrecht et al., *Nature* 350: 241-243 (1991)).

The homeodomain contains three α-helices (Quain et al., *Cell* 59: 573-580 (1989), the entirety of which is herein incorporated by reference). Residues in helix 3 contact the major groove of a nucleic acid in a sequence specific manner. Although structurally similar, different homeodomains are able to recognize diverse binding sites (Hanes et al., *Cell* 57: 1275-1283 (1989), the entirety of which is herein incorporated by reference; Treisamn et al., *Genes Dev.* 5: 594-604 (1991), the entirety of which is herein incorporated by reference; Affolter et al., *Proc. Natl. Acad. Sci. (U.S.A.)* 87: 4093-4097 (1990), the entirety of which is herein incorporated by reference; Percival-Smith et al., *EMBO J.* 9: 3967-3974 (1990), the entirety of which is herein incorporated by reference).

One class of homeodomain transcription factors are those that share a conserved cysteine-rich motif as illustrated by the *Arabidopsis* GLABRA2 homeodomain protein and the *Zea mays* KNOTTED1 (KN1)-like proteins (Vollbrecht et al., *Nature* 350: 241-243 (1991), Ma et al., *Plant. Molec. Biol.* 24: 465-473 (1994)). The morphological mutation Knotted1 in *Zea mays* alters the developmental fate of cells in leaf blades with wild-type expression of the gene localized in the meristem and ground tissue but absent from leaves or leaf primordia (Hake, *Trends in Genetics* 8:109-114 (1992), the entirety of which is herein incorporated by reference; Freeling and Hake, *Genetics* 111: 617-634 (1995), the entirety of which is herein incorporated by reference). In addition to having a homeodomain, the kn1 class of genes in *Zea mays* encode an ELK domain which contains repeating hydrophobic residues (Kerstetter et al., *Plant Cell* 6: 1877-1887 (1994), the entirety of which is herein incorporated by reference).

Kn1-like homeodomain genes have been reported in other plants, such as *Arabidopsis* (Lincoln et al., *Plant Cell* 6: 1859-1876 (1994), the entirety of which is herein incorporated by reference), tomato and soybean (Ma et al., *Plant Molecular Biology* 24: 465-473 (1994), the entirety of which is herein incorporated by reference).

Homeodomain transcription factors have been associated with the regulation of cell to cell communication and development in plants. Presence of the KNOTTED1 homeodomain transcription factor in a plant cell can lead to an increase in plasmodesmal size permitting the transport of larger molecules between cells (Lucas et al., *Science* 270: 1980-1983 (1995), the entirety of which is herein incorporated by reference).

Another class of transcription factors, the polycomb-like transcription factors, have been reported in plants (Goodrich et al., *Nature* 386: 44-51 (1997), the entirety of which is herein incorporated by reference). Wild type CLF, a polycomb-like transcription factor, isolated from *Arabidopsis*, exhibits extensive structural homology with *Drosphilia* Pc-G genes plants (Goodrich et al., *Nature* 386: 44-51 (1997)). Like *Drosphilia* Pc-G genes, the CLF genes encodes for a SET domain and two cysteine rich regions. CLF, while not being necessary for initial specification of stamen and carpel development, is reportedly necessary to later stages of development plants and represses a second transcription factor AGAMOUS (Goodrich et al., *Nature* 386: 44-51 (1997); Schumacher and Magnuson, *Trends in Genetics* 13(5): 167-170 (1997), the entirety of which is herein incorporated by reference).

A further class of transcription factors, those containing an AP2 domain, a conserved motif first identified in *Arabidopsis* (a floral mutant), has been identified in a number of plants (Jofuka et al., *Plant Cell* 6: 1211-1225 (1994), the entirety of which is herein incorporated by reference; Weigal et al., *Plant Cell* 7: 388-389 (1995), the entirety of which is herein incorporated by reference). The AP2 domain, which is a DNA-binding motif of about 60 amino acid has been reported, for example, to be present in the *Arabidopsis* transcription factors CBF1, APETALA2, AINTEGUMENTA, and TINY; as well as the tobacco ethylene response element binding proteins (Moose and Sisco, *Genes and Development* 10: 3018-3027 (1996), the entirety of which is herein incorporated by reference). Weigal et al., reports a 24 amino acid AP2 consensus domain which is predicted to form an amphipathic α-helix that may mediate protein-protein interactions (Weigal et al., *Plant Cell* 7: 388-389 (1995)).

Mutations of transcription factors containing an AP2 domain have been to effect floral and ovule development (Meyerowitz et al., *Cell* 88: 299-308 (1997), the entirety of which is herein incorporated by reference). Other transcription factors from this family have been reported to play a role in cold- and dehydration-regulated gene expression (Stockinger et al., *Proc. Natl. Acad Sci. (U.S.A.)* 94(3): 035-1040 (1997), the entirety of which is herein incorporated by reference).

Zinc-finger proteins have been isolated from plants (Takatsuji and Matsumoto, *J. Biol. Chem.* 271: 23368-23373

(1996), the entirety of which is herein incorporated by reference; Messner, *Plant Mol. Biol.* 33: 615-624 (1997), the entirety of which is herein incorporated by reference; Dietrich et al., *Cell* 88: 685-694 (1997), the entirety of which is herein incorporated by reference; Pater et al., *Nucleic Acid Research* 24: 4624-4631 (1996), the entirety of which is herein incorporated by reference; Tague and Goodman, *Plant Mole. Biol.* 28: 267-279 (1995), the entirety of which is herein incorporated by reference; Putterill et al., *Cell* 80: 847-857 (1995), the entirety of which is herein incorporated by reference; Takatsuji et al., *Plant Cell* 6: 947-958 (1994), the entirety of which is herein incorporated by reference). Zinc-finger proteins have been associated with a number of processes in plants including cell death (Dietrich et al., *Cell* 88: 685-694 (1997)) and flower morphology (Pater et al., *Nucleic Acid Research* 24: 4624-4631 (1996)).

The term zinc-finger has been applied to a broad set of protein motifs. Zinc-finger transcription factors may be subdivided into a number of categories. A category of zinc-finger transcription factors referred to as the $C_2H_2$ zinc finger transcription factors (also referred to as either TFIIA or Krüpell-like zinc fingers)(Meissner and Michael, *Plant Molecular Biology* 33: 615-624 (1997); Takatsuji et al., *EMBO J.* 11: 241-249 (1994), the entirety of which is herein incorporated by reference; Tague and Goodman, *Plant Mol. Biol.* 28: 267-279 (1995); Takasuji et al., *Plant Cell* 6: 947-948 (1994), Sakamoto et al., *Eur. J. Biochem.* 217: 1049-1056 (1993), the entirety of which is herein incorporated by reference; Saki et al., *Nature* 378: 199-203 (1995), the entirety of which is herein incorporated by reference). $C_2H_2$ zinc finger transcription factors have been reported, which contain one, two or three zinc fingers. These zinc fingers are maintained by cysteine and/or histidine residues organized around a zinc metal ion (Meissner and Michael, *Plant Molecular Biology* 33: 615-624 (1997)).

Examples of $C_2H_2$ zinc finger transcription factors include: the *petunia* Epf1 product which binds to an inverted repeat found in the promoter of EPSP, the W2f1 product from wheat, which binds to a nonameric motif found in the histone H3 promoter; the *Arabidopsis* AtZFP1 product associated with shoot development; and the *Arabidopsis* SUPERMAN product that is associated with negative regulation of B-function floral organ identity (Meissner and Michael, *Plant Molecular Biology* 33: 615-624 (1997); Takatsuji et al., *EMBO J.* 11: 241-249 (1994); Tague and Goodman, *Plant Mol. Biol.* 28: 267-279 (1995); Takasuji et al., *Plant Cell* 6: 947-948 (1994), Sakamoto et al., *Eur. J. Biochem.* 217: 1049-1056 (1993); Saki et al., *Nature* 378: 199-203 (1995)).

Another category of zinc-finger transcription factor include plant relatives of the GATA-1 transcription factor (Dietrich et al., *Cell* 88: 685-694 (1997); Evans and Felsenfeld *Cell* 58: 877-885 (1989), the entirety of which is herein incorporated by reference; Putterill et al., *Cell* 80: 847-857 (1995); Yanagisawa et al., *Nucleic Acid Research* 23: 3403-3410 (1995), the entirety of which is herein incorporated by reference; De Paolis et al., *Plant J.* 10: 215-224 (1996), the entirety of which is herein incorporated by reference; Lippuner et al., *J. Biol. Chem.* 271: 12859-12866 (1996), the entirety of which is herein incorporated by reference). GATA-1 like transcription factors have been associated with, for example, the regulation of cell death and the regulation of expression associated with salt stress.

II. Expresses Sequence Tag Nucleic Acid Molecules

Expressed sequence tags, or ESTs are randomly sequenced members of a cDNA library (or complementary DNA)(McCombie et al., *Nature Genetics* 1:124-130 (1992); Kurata et al., *Nature Genetics* 8:365-372 (1994); Okubo et al., *Nature Genetics* 2:173-179 (1992), all of which references are incorporated herein in their entirety). The randomly selected clones comprise insets that can represent a copy of up to the full length of a mRNA transcript.

Using conventional methodologies, cDNA libraries can be constructed from the mRNA (messenger RNA) of a given tissue or organism using poly dT primers and reverse transcriptase (Efstratiadis et al., *Cell* 7:279-3680 (1976), the entirety of which is herein incorporated by reference; Higuchi et al., *Proc. Natl. Acad. Sci.* (*U.S.A.*) 73:3146-3150 (1976), the entirety of which is herein incorporated by reference; Maniatis et al., *Cell* 8:163-182 (1976) the entirety of which is herein incorporated by reference; Land et al., *Nucleic Acids Res.* 9:2251-2266 (1981), the entirety of which is herein incorporated by reference; Okayama et al., *Mol. Cell. Biol.* 2:161-170 (1982), the entirety of which is herein incorporated by reference; Gubler et al., *Gene* 25:263-269 (1983), the entirety of which is herein incorporated by reference).

Several methods may be employed to obtain full-length cDNA constructs. For example, terminal transferase can be used to add homopolymeric tails of dC residues to the free 3' hydroxyl groups (Land et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, *Mol. Cell. Biol.* 2:161-170 (1982), the entirety of which is herein incorporated by reference, report a method for obtaining full length cDNA constructs. This method has been simplified by using synthetic primer-adapters that have both homopolymeric tails for priming the synthesis of the first and second strands and restriction sites for cloning into plasmids (Coleclough et al., *Gene* 34:305-314 (1985), the entirety of which is herein incorporated by reference) and bacteriophage vectors (Krawinkel et al., *Nucleic Acids Res.* 14:1913 (1986), the entirety of which is herein incorporated by reference; Han et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences (Davidson, *Gene Activity in Early Development*, 2nd ed., Academic Press, New York (1976), the entirety of which is herein incorporated by reference). The number of clones required to achieve a given probability that a low-abundance mRNA will be present in a cDNA library is $N=(\ln(1-P))/(\ln(1-1/n))$ where N is the number of clones required, P is the probability desired and 1/n is the fractional proportion of the total mRNA that is represented by a single rare mRNA (Sambrook et al., *Molecular Cloning: A Laboratory Manual*, 2nd ed., Cold Spring Harbor Laboratory Press (1989), the entirety of which is herein incorporated by reference).

A method to enrich preparations of mRNA for sequences of interest is to fractionate by size. One such method is to fractionate by electrophoresis through an agarose gel (Pennica et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest et al., *Proc. Natl. Acad. Sci.* (*U.S.A.*) 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali et al., *Proc. Natl. Acad. Sci.* (*U.S.A.*)

88:1943-1947 (1991), the entirety of which is herein incorporated by reference). Typically, the cDNA population is normalized by subtractive hybridization (Schmid et al., *J. Neurochem.* 48:307-312 (1987), the entirety of which is herein incorporated by reference; Fargnoli et al., *Anal. Biochem.* 187:364-373 (1990), the entirety of which is herein incorporated by reference; Travis et al., *Proc. Natl. Acad. Sci (U.S.A.)* 85:1696-1700 (1988), the entirety of which is herein incorporated by reference; Kato, *Eur. J. Neurosci.* 2:704-711 (1990); and Schweinfest et al., *Genet. Anal. Tech. Appl.* 7:64-70 (1990), the entirety of which is herein incorporated by reference). Subtraction represents another method for reducing the population of certain sequences in the cDNA library (Swaroop et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci. (U.S.A.)* 74:5463-5467 (1977), the entirety of which is herein incorporated by reference and the chemical degradation method of Maxam and Gilbert, *Proc. Nat. Acad. Sci. (U.S.A.)* 74:560-564 (1977), the entirety of which is herein incorporated by reference. Automation and advances in technology such as the replacement of radioisotopes with fluorescence-based sequencing have reduced the effort required to sequence DNA (Craxton, *Methods* 2:20-26 (1991), the entirety of which is herein incorporated by reference; Ju et al., *Proc. Natl. Acad. Sci. (U.S.A.)* 92:4347-4351 (1995), the entirety of which is herein incorporated by reference; Tabor and Richardson, *Proc. Natl. Acad. Sci. (U.S.A.)* 92:6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117:265-281 (1997), all of which are herein incorporated by reference in their entirety).

ESTs longer than 150 nucleotides have been found to be useful for similarity searches and mapping (Adams et al., *Science* 252:1651-1656 (1991), herein incorporated by reference). ESTs, which can represent copies of up to the full length transcript, may be partially or completely sequenced. Between 150-450 nucleotides of sequence information is usually generated as this is the length of sequence information that is routinely and reliably produced using single run sequence data. Typically, only single run sequence data is obtained from the cDNA library (Adams et al., *Science* 252:1651-1656 (1991). Automated single run sequencing typically results in an approximately 2-3% error or base ambiguity rate (Boguski et al., *Nature Genetics* 4:332-333 (1993), the entirety of which is herein incorporated by reference).

EST databases have been constructed or partially constructed from, for example, *C. elegans* (McCombrie et al., *Nature Genetics* 1:124-131 (1992)), human liver cell line HepG2 (Okubo et al., *Nature Genetics* 2:173-179 (1992)), human brain RNA (Adams et al., *Science* 252:1651-1656 (1991); Adams et al., *Nature* 355:632-635 (1992)), *Arabidopsis*, (Newman et al., *Plant Physiol.* 106:1241-1255 (1994)); and rice (Kurata et al., *Nature Genetics* 8:365-372 (1994)).

III. Sequence Comparisons

A characteristic feature of a DNA sequence is that it can be compared with other DNA sequences. Sequence comparisons can be undertaken by determining the similarity of the test or query sequence with sequences in publicly available or proprietary databases ("similarity analysis") or by searching for certain motifs ("intrinsic sequence analysis")(e.g. cis elements)(Coulson, *Trends in Biotechnology* 12:76-80 (1994), the entirety of which is herein incorporated by reference); Birren et al., *Genome Analysis* 1: Cold Spring Harbor Laboratory Press, Cold Spring Harbor, N.Y. 543-559 (1997), the entirety of which is herein incorporated by reference).

Similarity analysis includes database search and alignment. Examples of public databases include the DNA Database of Japan (DDBJ)(on the world wide web at ddbj.nig.ac.jp/); Genebank (on the world wide web at ncbi.nlm.nih.gov/Web/Search/Index.htlm); and the European Molecular Biology Laboratory Nucleic Acid Sequence Database (EMBL) (on the world wide web at ebi.ac.uk/ebi_docs/embl_db/embl-db.html). Other appropriate databases include dbEST (on the world wide web at ncbi.nlm.nih.gov/dbEST/index.html), SwissProt (on the world wide web at ebi.ac.uk/ebi_docs/swisprot_db/swisshome.html), PIR (on the world wide web at nbrt.georgetown.edu/pir/) and The Institute for Genome Research (on the world wide web at tigr.org/tdb/tdb.html).

A number of different search algorithms have been developed, one example of which are the suite of programs referred to as BLAST programs. There are five implementations of BLAST, three designed for nucleotide sequences queries (BLASTN, BLASTX and TBLASTX) and two designed for protein sequence queries (BLASTP and TBLASTN) (Coulson, *Trends in Biotechnology* 12:76-80 (1994); Birren et al., *Genome Analysis* 1, Cold Spring Harbor Laboratory Press, Cold Spring Harbor, N.Y. 543-559 (1997)).

BLASTN takes a nucleotide sequence (the query sequence) and its reverse complement and searches them against a nucleotide sequence database. BLASTN was designed for speed, not maximum sensitivity and may not find distantly related coding sequences. BLASTX takes a nucleotide sequence, translates it in three forward reading frames and three reverse complement reading frames and then compares the six translations against a protein sequence database. BLASTX is useful for sensitive analysis of preliminary (single-pass) sequence data and is tolerant of sequencing errors (Gish and States, *Nature Genetics* 3.266-272 (1993), the entirety of which is herein incorporated by reference). BLASTN and BLASTX may be used in concert for analyzing EST data (Coulson, *Trends in Biotechnology* 12:76-80 (1994); Birren et al., *Genome Analysis* 1:543-559 (1997)).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins* 17:49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36:290-300 (1993), the entirety of which is herein incorporated by reference, describes a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package that performs progressive multiple sequence alignments based on the method of Feng and Doolittle, *J. Mol. Evol.* 25:351-360 (1987), the entirety of which is herein incorporated by reference. Each pair of sequences is aligned and the distance between each pair is calculated; from this distance matrix, a guide tree is calculated and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both pairwise alignments and multiple alignments. CLUSTAL W for UNIX and VMS systems is available at: ftp.ebi.ac.uk. Another program is MACAW (Schuler et al., *Proteins Struct. Func. Genet.* 9:180-190 (1991), the entirety of which is herein incorporated by reference, for which both Macintosh and Microsoft Windows versions are available. MACAW uses a graphical interface, provides a choice of several alignment algorithms and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research* 22:3583-3589 (1994), the entirety of which is herein incorporated by reference). PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by Henikoff, *Trends Biochem Sci.* 18:267-268 (1993), the entirety of which is herein incorporated by reference; Henikoff and Henikoff, *Nucleic Acid Research* 19:6565-6572 (1991), the entirety of which is herein incorporated by reference; Henikoff and Henikoff, *Proteins* 17:49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein query or a nucleotide query can be submitted to the BLOCKS server; if a nucleotide sequence is submitted, the sequence is translated in all six reading frames and motifs are sought for these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches such as GCG program ProfileSearch and Hidden Markov Models (HMMs)(Krough et al, *J. Mol. Biol.* 235:1501-1531, (1994); Eddy, *Current Opinion in Structural Biology* 6:361-365, (1996), both of which are herein incorporated by reference in their entirety). In both cases, a large number of common protein domains have been converted into profiles, as present in the PROSITE library, or HHM models, as in the Pfam protein domain library (Sonnhammer et al, *Proteins* 28:405-420 (1997), the entirety of which is herein incorporated by reference). Pfam contains more than 500 HMM models for enzymes, transcription factors, signal transduction molecules and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al., *Proc. Natl. Acad Sci. (U.S.A.)* 91:12091-12095 (1994), the entirety of which is herein incorporated by reference). On the basis of an aligned set of input sequences, a weight matrix is calculated by using one of four methods (selected by the user). A weight matrix is simply a representation, position by position of how likely a particular amino acid will appear. The calculated weight matrix is then used to search the databases. To increase sensitivity, newly found sequences are added to the original data set, the weight matrix is recalculated and the search is performed again. This procedure continues until no new sequences are found.

SUMMARY OF THE INVENTION

The present invention provides a substantially purified nucleic acid molecule that encodes a maize, soybean or *Arabidopsis thaliana* transcription factor or fragment thereof, wherein the maize, soybean, or *Arabidopsis thaliana* transcription factor is selected from the group consisting of: (a) homeobox transcription factor (b) HLH transcription factor (c) leucine zipper transcription factor (d) zinc finger transcription factor and (e) other transcription factors.

The present invention also provides a substantially purified nucleic acid molecule that encodes a plant transcription factor or fragment thereof, wherein the nucleic acid molecule is selected from the group consisting of a nucleic acid molecule that encodes a maize, soybean or *Adrabidopsis thaliana* homeobox transcription factor or fragment thereof, a nucleic acid molecule that encodes a maize, soybean or *Arabidopsis thaliana* HLH transcription factor or fragment thereof, a nucleic acid molecule that encodes a maize, soybean or *Arabidopsis thaliana* leucine zipper transcription factor or fragment thereof, a nucleic acid molecule that encodes a maize, soybean or *Arabidopsis thaliana* zinc finger transcription factor or fragment thereof and a nucleic acid molecule that encodes a maize, soybean or *Arabidopsis thaliana* other transcription factor or fragment thereof.

The present invention also provides a substantially purified maize, soybean or *Arabidopsis thaliana* transcription factor or fragment thereof, wherein the maize or soybean transcription factor is selected from the group consisting of (a) homeobox transcription factor or fragment thereof; (b) HLH transcription factor or fragment thereof, (c) leucine zipper transcription factor or fragment thereof, (d) zinc finger transcription factor or fragment thereof and (e) other transcription factors or fragments thereof.

The present invention also provides a substantially purified maize, soybean or *Arabidopsis thaliana* transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 3853.

The present invention also provides a substantially purified maize, soybean or *Arabidopsis thaliana* homeobox transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 49, SEQ ID NO 1415 through SEQ ID NO: 1555 and SEQ ID NO: 1746 through SEQ ID NO: 2000.

The present invention also provides a substantially purified maize, soybean or *Arabidopsis thaliana* homeobox transcription factor or fragment thereof encoded by a nucleic acid sequence selected from the group consisting of SEQ ID NO: 1 through SEQ ID NO: 49, SEQ ID NO 1415 through SEQ ID NO: 1555 and SEQ ID NO: 1746 through SEQ ID NO: 2000.

The present invention also provides a substantially purified maize, soybean or *Arabidopsis thaliana* HLH transcription factor or fragment thereof encoded by a first nucleic acid molecule which specifically hybridizes to a second nucleic acid molecule, the second nucleic acid molecule having a nucleic acid sequence selected from the group consisting of a complement SEQ ID NO: 50 through SEQ ID NO: 65, SEQ ID NO: 1724 through SEQ ID NO: 1745 and SEQ ID NO: 2001 through SEQ ID NO: 2085.

The present invention also provides a substantially purified maize, soybean or *Arabidopsis thaliana* HLH transcription factor or fragment thereof encoded by a nucleic acid sequence selected from the group consisting of SEQ ID NO: 50 through SEQ ID NO: 65, SEQ ID NO: 1724 through SEQ ID NO: 1745 and SEQ ID NO: 2001 through SEQ ID NO: 2085.

The present invention also provides a substantially purified maize, soybean or *Arabidopsis thaliana* leucine zipper transcription factor or fragment thereof encoded by a first nucleic acid molecule which specifically hybridizes to a second nucleic acid molecule, the second nucleic acid molecule having a nucleic acid sequence consisting of a complement of SEQ ID NO: 46 through SEQ ID NO: 47, SEQ ID NO: 66 through SEQ ID NO: 93, SEQ ID NO: 335, SEQ ID NO: 1475, SEQ ID NO: 1506, SEQ ID NO: 1523, SEQ ID NO: 1556 through SEQ ID NO: 1723, SEQ ID NO: 1752, SEQ ID NO: 1764, SEQ ID NO: 1771, SEQ ID NO: 1774, SEQ ID NO: 1804, SEQ ID NO: 1809 through SEQ ID NO: 1810, SEQ ID NO: 1822, SEQ ID NO: 1830, SEQ ID NO: 1840 through SEQ ID NO: 1845, SEQ ID NO: 1847-1854, SEQ ID NO: 1857 through 1862, SEQ ID NO: 1869, SEQ ID NO: 1878 through SEQ ID NO: 1879, SEQ ID NO: 1881 through SEQ ID NO: 1890, SEQ ID NO: 1892 through SEQ ID NO: 1896, SEQ ID NO: 1898 through SEQ ID NO: 1903, SEQ ID NO: 1905 through SEQ ID NO: 1907, SEQ ID NO: 1909 through SEQ ID NO: 1912, SEQ ID NO: 1932 through SEQ ID NO: 1938, SEQ ID NO: 1950 through SEQ ID NO: 1954, SEQ ID NO: 1959 through SEQ ID NO: 1961, SEQ ID NO: 1971 through SEQ ID NO: 1984, SEQ ID NO: 1990, SEQ ID NO: 1992 through SEQ ID NO: 1993, SEQ ID NO: 1995 through SEQ ID NO: 1998 and SEQ ID NO: 2086 through SEQ ID NO: 2275.

The present invention also provides a substantially purified maize, soybean or *Arabidopsis thaliana* leucine zipper transcription factor or fragment thereof encoded by a nucleic acid sequence consisting of SEQ ID NO: 46 through SEQ ID NO: 47, SEQ ID NO: 66 through SEQ ID NO: 93, SEQ ID NO: 335, SEQ ID NO: 1475, SEQ ID NO: 1506, SEQ ID NO: 1523, SEQ ID NO: 1556 through SEQ ID NO: 1723, SEQ ID NO: 1752, SEQ ID NO: 1764, SEQ ID NO: 1771, SEQ ID NO: 1774, SEQ ID NO: 1804, SEQ ID NO: 1809 through SEQ ID NO: 1810, SEQ ID NO: 1822, SEQ ID NO: 1830, SEQ ID NO: 1840 through SEQ ID NO: 1845, SEQ ID NO: 1847 through 1854, SEQ ID NO: 1857 through 1862, SEQ ID NO: 1869, SEQ ID NO: 1878 through SEQ ID NO: 1879, SEQ ID NO: 1881 through SEQ ID NO: 1890, SEQ ID NO: 1892 through SEQ ID NO: 1896, SEQ ID NO: 1898 through SEQ ID NO: 1903, SEQ ID NO: 1905 through SEQ ID NO: 1907, SEQ ID NO: 1909 through SEQ ID NO: 1912, SEQ ID NO: 1932 through SEQ ID NO: 1938, SEQ ID NO: 1950 through SEQ ID NO: 1954, SEQ ID NO: 1959 through SEQ ID NO: 1961, SEQ ID NO: 1971 through SEQ ID NO: 1984, SEQ ID NO: 1990, SEQ ID NO: 1992 through SEQ ID NO: 1993, SEQ ID NO: 1995 through SEQ ID NO: 1998 and SEQ ID NO: 2086 through SEQ ID NO: 2275.

The present invention also provides a substantially purified maize, soybean or *Arabidopsis thaliana* zinc finger transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 94 through SEQ ID NO: 148, SEQ ID NO: 300 through SEQ ID NO: 596, SEQ ID NO: 2118 and SEQ ID NO: 2276 through SEQ ID NO: 2686.

The present invention also provides a substantially purified maize, soybean or *Arabidopsis thaliana* zinc finger transcription factor or fragment thereof encoded by a nucleic acid sequence selected from the group consisting of SEQ ID NO: 94 through SEQ ID NO: 148, SEQ ID NO: 300 through SEQ ID NO: 596, SEQ ID NO: 2118 and SEQ ID NO: 2276 through SEQ ID NO: 2686.

The present invention also provides a substantially purified maize, soybean or *Arabidopsis thaliana* other transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 149 through SEQ ID NO: 299, SEQ ID NO: 597 through SEQ ID NO: 1414 and SEQ ID NO: 2687 through SEQ ID NO: 3853.

The present invention also provides a substantially purified maize, soybean or *Arabidopsis thaliana* other transcription factor or fragment thereof encoded by a nucleic acid sequence selected from the group consisting of SEQ ID NO: 149 through SEQ ID NO: 299, SEQ ID NO: 597 through SEQ ID NO: 1414 and SEQ ID NO: 2687 through SEQ ID NO: 3853.

The present invention also provides a purified antibody or fragment thereof which is capable of specifically binding to a maize, soybean or *Arabidopsis thaliana* transcription factor or fragment thereof, wherein the maize, soybean or *Arabidopsis thaliana* transcription factor or fragment thereof is encoded by a nucleic acid molecule comprising a nucleic acid sequence selected from the group consisting of consisting of SEQ ID NO: 1 through SEQ ID NO: 3853.

The present invention also provides a substantially purified antibody or fragment thereof, the antibody or fragment thereof capable of specifically binding to a maize, soybean or *Arabidopsis thaliana* homeobox transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 49, SEQ ID NO 1415 through SEQ ID NO: 1555 and SEQ ID NO: 1746 through SEQ ID NO: 2000 or a nucleic acid sequence selected from the group consisting SEQ ID NO: 1 through SEQ ID NO: 49, SEQ ID NO 1415 through SEQ ID NO: 1555 and SEQ ID NO: 1746 through SEQ ID NO: 2000.

The present invention also provides a substantially purified antibody or fragment thereof, the antibody or fragment thereof capable of specifically binding to a maize, soybean or *Arabidopsis thaliana* HLH transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 50 through SEQ ID NO: 65, SEQ ID NO: 1724 through SEQ ID NO: 1745 and SEQ ID NO: 2001 through SEQ ID NO: 2085 or a nucleic acid sequence selected from the group consisting of SEQ ID NO: 50 through SEQ ID NO: 65, SEQ ID NO: 1724 through SEQ ID NO: 1745 and SEQ ID NO: 2001 through SEQ ID NO: 2085.

The present invention also provides a substantially purified antibody or fragment thereof, the antibody or fragment thereof capable of specifically binding to a maize, soybean or *Arabidopsis thaliana* leucine zipper transcription factor or fragment thereof encoded by a first nucleic acid molecule which specifically hybridizes to a second nucleic acid molecule, the second nucleic acid molecule consisting of a compliment of a nucleic acid sequence having a nucleic acid sequence selected from the group consisting of SEQ ID NO: 46 through SEQ ID NO: 47, SEQ ID NO: 66 through SEQ ID NO: 93, SEQ ID NO: 335, SEQ ID NO: 1475, SEQ ID NO: 1506, SEQ ID NO: 1523, SEQ ID NO: 1556 through SEQ ID NO: 1723, SEQ ID NO: 1752, SEQ ID NO: 1764, SEQ ID NO: 1771, SEQ ID NO: 1774, SEQ ID NO: 1804, SEQ ID NO: 1809 through SEQ ID NO: 1810, SEQ ID NO: 1822, SEQ ID NO: 1830, SEQ ID NO: 1840 through SEQ ID NO: 1845, SEQ ID NO: 1847 through 1854, SEQ ID NO: 1857 through 1862, SEQ ID NO: 1869, SEQ ID NO: 1878 through SEQ ID NO: 1879, SEQ ID NO: 1881 through SEQ ID NO: 1890, SEQ ID NO: 1892 through SEQ ID NO: 1896, SEQ ID NO: 1898 through SEQ ID NO: 1903, SEQ ID NO: 1905 through SEQ ID NO: 1907, SEQ ID NO: 1909 through SEQ ID NO: 1912, SEQ ID NO: 1932 through SEQ ID NO: 1938, SEQ ID NO: 1950 through SEQ ID NO: 1954, SEQ ID NO: 1959 through SEQ ID NO: 1961, SEQ ID NO: 1971 through SEQ ID NO: 1984, SEQ ID NO: 1990, SEQ ID NO: 1992 through SEQ ID NO: 1993, SEQ ID NO: 1995 through SEQ ID NO: 1998 and SEQ ID NO: 2086 through SEQ ID NO: 2275 or a nucleic acid sequence selected from the group consisting of SEQ ID NO: 46 through SEQ ID NO: 47, SEQ ID NO: 66 through SEQ ID NO: 93, SEQ ID NO: 335, SEQ ID NO: 1475, SEQ ID NO: 1506, SEQ ID NO: 1523, SEQ ID NO: 1556 through SEQ ID NO: 1723, SEQ ID NO: 1752, SEQ ID NO: 1764, SEQ ID NO: 1771, SEQ ID NO: 1774, SEQ ID NO: 1804, SEQ ID NO: 1809 through SEQ ID NO: 1810, SEQ ID NO: 1822, SEQ ID NO: 1830, SEQ ID NO: 1840 through SEQ ID NO: 1845, SEQ ID NO: 1847 through 1854, SEQ ID NO: 1857 through 1862, SEQ ID NO: 1869, SEQ ID NO: 1878 through SEQ ID NO: 1879, SEQ ID NO: 1881 through SEQ ID NO: 1890, SEQ ID NO: 1892 through SEQ ID NO: 1896, SEQ ID NO: 1898 through SEQ ID NO: 1903, SEQ ID NO: 1905 through SEQ ID NO: 1907, SEQ ID NO: 1909 through SEQ ID NO: 1912, SEQ ID NO: 1932 through SEQ ID NO: 1938, SEQ ID NO: 1950 through SEQ ID NO: 1954, SEQ ID NO: 1959 through SEQ ID NO: 1961, SEQ ID NO: 1971 through SEQ ID NO: 1984, SEQ ID NO: 1990, SEQ ID NO: 1992 through SEQ ID NO: 1993, SEQ ID NO: 1995 through SEQ ID NO: 1998 and SEQ ID NO: 2086 through SEQ ID NO: 2275.

The present invention also provides a substantially purified antibody or fragment thereof, the antibody or fragment thereof capable of specifically binding to a maize, soybean or *Arabidopsis thaliana* zinc finger transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 94 through SEQ ID NO: 148, SEQ ID NO: 300 through SEQ ID NO: 596, SEQ ID NO: 2118 and SEQ ID NO: 2276 through SEQ ID NO: 2686 or a nucleic acid sequence selected from the group consisting SEQ ID NO: 94 through SEQ ID NO: 148, SEQ ID NO: 300 through SEQ ID NO: 596, SEQ ID NO: 2118 and SEQ ID NO: 2276 through SEQ ID NO: 2686.

The present invention also provides a substantially purified antibody or fragment thereof, the antibody or fragment thereof capable of specifically binding to a maize, soybean or *Arabidopsis thaliana* other transcription factor or fragment thereof encoded by a first nucleic acid molecule which specifically hybridizes to a second nucleic acid molecule, the second nucleic acid molecule having a nucleic acid sequence selected from the group consisting of a complement of SEQ ID NO: 149 through SEQ ID NO: 299, SEQ ID NO: 597 through SEQ ID NO: 1414 and SEQ ID NO: 2687 through SEQ ID NO: 3853 or a nucleic acid sequence selected from the group consisting SEQ ID NO: 149 through SEQ ID NO: 299, SEQ ID NO: 597 through SEQ ID NO: 1414 and SEQ ID NO: 2687 through SEQ ID NO: 3853.

The present invention also provides a transformed plant having a nucleic acid molecule which comprises: (A) an exogenous promoter region which functions in a plant cell to cause the production of a mRNA molecule; (B) a structural nucleic acid molecule comprising a nucleic acid sequence selected from the group consisting of (a) a nucleic acid sequence which encodes for a homeobox transcription factor or fragment thereof; (b) a nucleic acid sequence which encodes for a HLH transcription factor or fragment thereof; (c) a nucleic acid sequence which encodes for a leucine zipper transcription factor or fragment thereof; (d) a nucleic acid sequence which encodes for a zinc finger transcription factor or fragment thereof; (e) a nucleic acid sequence which encodes for an other transcription factor or fragment thereof; (f) a nucleic acid sequence which is complementary to any of the nucleic acid sequences of (a) through (d); and (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule encodes a plant transcription factor or fragment thereof, the structural nucleic acid molecule comprising a nucleic acid sequence selected from the group consisting of SEQ ID NO: 1 through SEQ ID NO: 3853 or fragment thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule is selected from the group consisting of a nucleic acid molecule that encodes a maize, soybean or *Arabidopsis thaliana* homeobox transcription factor or fragment thereof, a nucleic acid molecule that encodes a maize, soybean or *Arabidopsis thaliana* HLH transcription factor or fragment thereof, a nucleic acid molecule that encodes a maize, soybean, or *Arabidopsis thaliana* leucine zipper transcription factor or fragment thereof, a nucleic acid molecule that encodes a maize, soybean, or *Arabidopsis thaliana* zinc finger transcription factor or fragment thereof, and a nucleic acid molecule that encodes a maize, soybean, or *Arabidopsis thaliana* other transcription factors or fragments thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a transcribed nucleic acid molecule with a transcribed strand and a non-transcribed strand, wherein the transcribed strand is complementary to a nucleic acid molecule comprising a nucleic acid sequence selected from the group consisting of SEQ ID NO: 1 through SEQ ID NO: 3853 or fragment thereof; which is linked to (C) a 3' non-translated sequence that functions in plant cells to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to: (B) a transcribed nucleic acid molecule with a transcribed strand and a non-transcribed strand, wherein a transcribed mRNA of the transcribed strand is complementary to an endogenous mRNA molecule having a nucleic acid sequence selected from the group consisting of an endogenous mRNA molecule that encodes a maize, soybean or *Arabidopsis thaliana* homeobox transcription factor or fragment thereof, an endogenous mRNA molecule that encodes a maize, soybean or *Arabidopsis thaliana* HLH transcription factor or fragment thereof, an endogenous mRNA molecule that encodes a maize, soybean or *Arabidopsis thaliana* leucine zipper transcription factor or fragment thereof, an endogenous mRNA molecule that encodes a maize, soybean or *Arabidopsis thaliana* zinc finger transcription factor or fragment thereof and an endogenous mRNA molecule that encodes a maize, soybean or *Arabidopsis thaliana* other transcription factor or fragment thereof; which is linked to (C) a 3' non-translated sequence that functions in the plant cell to cause termination of transcription and addition of polyadenylated ribonucleotides to a 3' end of the mRNA molecule.

The present invention also provides a method for determining a level or pattern of a plant transcription factor in a plant cell or plant tissue comprising: (A) incubating, under conditions permitting nucleic acid hybridization, a marker nucleic acid molecule, the marker nucleic acid molecule having a nucleic acid sequence selected from the group consisting of SEQ ID NO: 1 through SEQ ID NO: 3853 or complements thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant transcription factor; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant transcription factor.

The present invention also provides a method for determining a level or pattern of a plant transcription factor in a plant cell or plant tissue comprising: (A) incubating, under conditions permitting nucleic acid hybridization, a marker nucleic acid molecule, the marker nucleic acid molecule comprising a nucleic acid molecule that encodes a maize, soybean or *Arabidopsis thaliana* homeobox transcription factor or complement thereof or fragment of either, a nucleic acid molecule that encodes a maize, soybean or *Arabidopsis thaliana* HLH transcription factor or complement thereof or fragment of either, a nucleic acid molecule that encodes a maize, soybean or *Arabidopsis thaliana* leucine zipper transcription factor or complement thereof or fragment of either, a nucleic acid molecule that encodes a maize, soybean or *Arabidopsis thaliana* zinc finger transcription factor or complement thereof or fragment cf either and a nucleic acid molecule that encodes a maize, soybean or *Arabidopsis thaliana* other transcription factor or complement thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant transcription factor; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant transcription factor.

The present invention also provides a method for determining a level or pattern of a plant transcription factor in a plant cell or plant tissue under evaluation which comprises assaying the concentration of a molecule, whose concentration is dependent upon the expression of a gene, the gene specifically hybridizes to a nucleic acid molecule having a nucleic acid sequence selected from the group consisting of SEQ ID NO: 1 through SEQ ID NO: 3853 or complements thereof, in comparison to the concentration of that molecule present in a reference plant cell or a reference plant tissue with a known level or pattern of the plant transcription factor, wherein the assayed concentration of the molecule is compared to the assayed concentration of the molecule in the reference plant cell or reference plant tissue with the known level or pattern of the plant transcription factor.

The present invention also provides a method for determining a level or pattern of a plant transcription factor in a plant cell or plant tissue under evaluation which comprises assaying the concentration of a molecule, whose concentration is dependent upon the expression of a gene, the gene specifically hybridizes to a nucleic acid molecule selected from the group consisting of a nucleic acid molecule that encodes a maize, soybean or *Arabidopsis thaliana* homeobox transcription factor or complement thereof, a nucleic acid molecule that encodes a maize, soybean or *Arabidopsis thaliana* HLH transcription factor or complement thereof, a nucleic acid molecule that encodes a maize, soybean or *Arabidopsis thaliana* leucine zipper transcription factor or complement thereof, a nucleic acid molecule that encodes a maize, soybean or *Arabidopsis thaliana* zinc finger transcription factor or complement thereof and a nucleic acid molecule that encodes a maize, soybean or *Arabidopsis thaliana* other transcription factor or complement thereof, in comparison to the concentration of that molecule present in a reference plant cell or a reference plant tissue with a known level or pattern of the plant transcription factor, wherein the assayed concentration of the molecule is compared to the assayed concentration of the molecule in the reference plant cell or the reference plant tissue with the known level or pattern of the plant transcription factor.

The present invention provides a method of determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule having a nucleic acid sequence selected from the group of SEQ ID NO: 1 through SEQ ID NO: 3853 or complements thereof or fragment of either and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the protein in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of a plant transcription factor comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule having a nucleic acid sequence selected from the group consisting of SEQ ID NO: 1 through SEQ ID NO: 3853 or complements thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant transcription factor in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of a plant transcription factor comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule selected from the group consisting of a nucleic acid molecule that encodes a maize, soybean or *Arabidopsis thaliana* homeobox transcription factor or complement thereof, a nucleic acid molecule that encodes a maize, soybean or *Arabidopsis thaliana* HLH transcription factor or complement thereof, a nucleic acid molecule that encodes a maize, soybean or *Arabidopsis thaliana* leucine zipper transcription factor or complement thereof, a nucleic acid molecule that encodes a maize, soybean or *Arabidopsis thaliana* zinc finger transcription factor or complement thereof and a nucleic acid molecule that encodes a maize, soybean or *Arabidopsis thaliana* other transcription factor or complement thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant transcription factor in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method of producing a plant containing an overexpressed protein comprising: (A) transforming the plant with a functional nucleic acid molecule, wherein the functional nucleic acid molecule comprises a promoter region, wherein the promoter region is linked to a structural region, wherein the structural region has a nucleic acid sequence selected from group consisting of SEQ ID NO: 1 through SEQ ID NO: 3853 wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the protein; and (B) growing the transformed plant.

The present invention also provides a method of producing a plant containing an overexpressed plant transcription factor comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 3853 or fragment thereof; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the plant transcription factor; and (B) growing the transformed plant.

The present invention also provides a method of producing a plant containing an overexpressed plant transcription factor comprising: (A) transforming the plant with a functional nucleic acid molecule, wherein the functional nucleic acid molecule comprises a promoter region, wherein the promoter region is linked to a structural region, wherein the structural region comprises a nucleic acid molecule selected from the group consisting of a nucleic acid molecule that encodes a maize, soybean or *Arabidopsis thaliana* homeobox transcription factor or fragment thereof, a nucleic acid molecule that encodes a maize, soybean or *Arabidopsis thaliana* HLH transcription factor or fragment thereof, a nucleic acid molecule that encodes a maize, soybean or *Arabidopsis thaliana* leucine zipper transcription factor or fragment thereof, a nucleic acid molecule that encodes a maize, soybean or *Arabidopsis thaliana* zinc finger transcription factor or fragment thereof and a nucleic acid molecule that encodes a maize, soybean or *Arabidopsis thaliana* other transcription factor or fragment thereof, wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the plant transcription factor; and (B) growing the transformed plant.

The present invention also provides a method of producing a plant containing reduced levels of a plant transcription factor comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 3853; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant transcription factor; and (B) growing the transformed plant.

The present invention also provides a method of producing a plant containing reduced levels of a plant transcription factor comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of a nucleic acid molecule that encodes a maize, soybean or *Arabidopsis thaliana* homeobox transcription factor or fragment thereof, a nucleic acid molecule that encodes a maize, soybean or *Arabidopsis thaliana* HLH transcription factor or fragment thereof, a nucleic acid molecule that encodes a maize, soybean or *Arabidopsis thaliana* leucine zipper transcription factor or fragment thereof, a nucleic acid molecule that encodes a maize, soybean or *Arabidopsis thaliana* leucine zinc finger transcription factor or fragment thereof and a nucleic acid molecule that encodes a maize, soybean or *Arabidopsis thaliana* other transcription factor or fragment thereof, wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant transcription factor; and (B) growing the transformed plant.

The present invention also provides a method for reducing expression of a plant transcription factor in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein the transcribed strand is complementary to a nucleic acid molecule having a nucleic acid sequence selected from the group consisting of SEQ ID NO: 1 through SEQ ID NO: 3853 or complements thereof or fragments of either and the transcribed strand is complementary to an endogenous mRNA molecule; and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method for reducing expression of a plant transcription factor in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein a transcribed mRNA of the transcribed strand is complementary to a nucleic acid molecule selected from the group consisting of an endogenous mRNA molecule that encodes a maize, soybean or *Arabidopsis thaliana* homeobox transcription factor or fragment thereof, an endogenous mRNA molecule that encodes a maize, soybean or *Arabidopsis thaliana* HLH transcription factor or fragment thereof, an endogenous mRNA molecule that encodes a maize, soybean or *Arabidopsis thaliana* leucine zipper transcription factor or fragment thereof, an endogenous mRNA molecule that encodes a maize, soybean or *Arabidopsis thaliana* zinc finger transcription factor or fragment thereof and an endogenous mRNA molecule that encodes a maize, soybean or *Arabidopsis thaliana* other transcription factor or fragment thereof, and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method of determining an association between a polymorphism and a plant trait comprising: (A) hybridizing a nucleic acid molecule specific for the polymorphism to genetic material of a plant, wherein the nucleic acid molecule has a nucleic acid sequence selected from the group consisting of SEQ ID NO: 1 through SEQ ID NO: 3853 or complements thereof or fragment of either; and (B) calculating the degree of association between the polymorphism and the plant trait.

The present invention also provides a method of determining an association between a polymorphism and a plant trait comprising: (A) hybridizing a nucleic acid molecule specific for the polymorphism to genetic material of a plant, wherein the nucleic acid molecule is selected from the group consisting of a nucleic acid molecule that encodes a maize, soybean or *Arabidopsis thaliana* homeobox transcription factor or complement thereof or fragment of either, a nucleic acid molecule that encodes a maize, soybean or *Arabidopsis thaliana* HLH transcription factor or complement thereof or fragment of either, a nucleic acid molecule that encodes a maize, soybean or *Arabidopsis thaliana* leucine zipper transcription factor or complement thereof or fragment of either, a nucleic acid molecule that encodes a maize, soybean or *Arabidopsis thaliana* zinc finger transcription factor or complement thereof or fragment of either and a nucleic acid molecule that encodes a maize, soybean or *Arabidopsis thaliana* other transcription factor or complement thereof or fragment of either and (B) calculating the degree of association between the polymorphism and the plant trait.

The present invention also provides a method of isolating a nucleic acid that encodes a plant transcription factor or fragment thereof comprising: (A) incubating under conditions permitting nucleic acid hybridization, a first nucleic acid molecule comprising a nucleic acid sequence selected from the group consisting of SEQ ID NO: 1 through SEQ ID NO: 3853 or complements thereof or fragment of either with a complementary second nucleic acid molecule obtained from a plant cell or plant tissue; (B) permitting hybridization between the first nucleic acid molecule and the second nucleic acid molecule obtained from the plant cell or plant tissue; and (C) isolating the second nucleic acid molecule.

The present invention also provides a method of isolating a nucleic acid molecule that encodes a plant transcription factor or fragment thereof comprising: (A) incubating under conditions permitting nucleic acid hybridization, a first nucleic acid molecule selected from the group consisting of a nucleic acid molecule that encodes a maize, soybean or *Arabidopsis thaliana* homeobox transcription factor or complement thereof or fragment of either, a nucleic acid molecule that encodes a maize, soybean or *Arabidopsis thaliana* HLH transcription factor or complement thereof or fragment of either, a nucleic acid molecule that encodes a maize, soybean or *Arabidopsis thaliana* leucine zipper transcription factor or complement thereof or fragment of either, a nucleic acid molecule that encodes a maize, soybean or *Arabidopsis thaliana* zinc finger transcription factor or complement thereof or fragment of either and a nucleic acid molecule that encodes a maize, soybean or *Arabidopsis thaliana* other transcription factor or complement thereof or fragment of either, with a complementary second nucleic acid molecule obtained from a plant cell or plant tissue; (B) permitting hybridization between the plant transcription factor nucleic acid molecule and the complementary nucleic acid molecule obtained from the plant cell or plant tissue; and (C) isolating the second nucleic acid molecule.

DETAILED DESCRIPTION OF THE INVENTION

Agents of the Present Invention

Agents (a) Nucleic Acid Molecules

Agents of the present invention include plant nucleic acid molecules and more preferably include maize, soybean and *Arabidopsis thaliana* nucleic acid molecules and more preferably include nucleic acid molecules of the maize genotypes B73 (Illinois Foundation Seeds, Champaign, Ill. U.S.A.), B73×Mo17 (Illinois Foundation Seeds, Champaign, Ill. U.S.A.), DK604 (Dekalb Genetics, Dekalb, Ill. U.S.A.), H99 (Illinois Foundation Seeds, Champaign, Ill. U.S.A.), RX601 (Asgrow Seed Company, Des Moines, Iowa), Mo17 (Illinois Foundation Seeds, Champaign, Ill. U.S.A.), and soybean types Asgrow 3244 (Asgrow Seed Company, Des Moines, Iowa), C1944 (United States Department of Agriculture (USDA) Soybean Germplasm Collection, Urbana, Ill. U.S.A.), Cristalina (USDA Soybean Germplasm Collection, Urbana, Ill. U.S.A.), FT108 (Monsoy, Brazil), Hartwig (USDA Soybean Germplasm Collection, Urbana, Ill. U.S.A.), BW211S Null (Tohoku University, Morioka, Japan), PI507354 (USDA Soybean Germplasm Collection, Urbana, Ill. U.S.A.), Asgrow A4922 (Asgrow Seed Company, Des Moines, Iowa U.S.A.), PI227687 (USDA Soybean Germplasm Collection, Urbana, Ill. U.S.A.), PI229358 (USDA Soybean Germplasm Collection, Urbana, Ill. U.S.A.) and Asgrow A3237 (Asgrow Seed Company, Des Moines, Iowa U.S.A.).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

Fragment nucleic acid molecules may encode significant portion(s) of, or indeed most of, these nucleic acid molecules. Alternatively, the fragments may comprise smaller oligonucleotides (having from about 15 to about 250 nucleotide residues and more preferably, about 15 to about 30 nucleotide residues).

As used herein, an agent, be it a naturally occurring molecule or otherwise may be "substantially purified," if desired, such that one or more molecules that is or may be present in a naturally occurring preparation containing that molecule will have been removed or will be present at a lower concentration than that at which it would normally be found.

The agents of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

It is understood that the agents of the present invention may be labeled with reagents that facilitate detection of the agent (e.g. fluorescent labels, Prober et al., *Science* 238:336-340 (1987); Albarella et al., EP 144914; chemical labels, Sheldon et al., U.S. Pat. No. 4,582,789; Albarella et al., U.S. Pat. No. 4,563,417; modified bases, Miyoshi et al., EP 119448, all of which are hereby incorporated by reference in their entirety).

It is further understood, that the present invention provides recombinant bacterial, mammalian, microbial, insect, fungal and plant cells and viral constructs comprising the agents of the present invention. (See, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells)

Nucleic acid molecules or fragments thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Molecular Cloning*, A Laboratory Manual, 2nd Ed., Cold Spring Harbor Press, Cold Spring Harbor, N.Y. (1989) and by Haymes et al., *Nucleic Acid Hybridization, A Practical Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2× SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 3853 or complements thereof under moderately stringent conditions, for example at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO: 1 through SEQ ID NO: 3853 or complements thereof under high stringency conditions such as 0.2×SSC and about 65° C.

In one aspect of the present invention, the nucleic acid molecules of the present invention have one or more of the nucleic acid sequences set forth in SEQ ID NO: 1 through SEQ ID NO: 3853 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO: 3853 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO: 3853 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO: 3853 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO: 3853 or complements thereof.

In a further more preferred aspect of the present invention, one or more of the nucleic acid molecules of the present invention exhibit 100% sequence identity with a nucleic acid molecule present within MONN01, SATMON001, SATMON003 through SATMON014, SATMON016 through SATMON031, SATMON033, SATMON034, SATMON~001, SATMONN01, SATMONN04 through SATMONN006, CMz029 through CMz031, CMz033 through CMz037, CMz039 through CMz042, CMz044 through CMz045, CMz047 through CMz050, SOYMON001 through SOYMON038, Soy51 through Soy56, Soy58 through Soy62, Soy65 through Soy73 and Soy76 through Soy77, Lib9, Lib22 through Lib25, Lib35, and Lib146 (Monsanto Company, St. Louis, Mo. U.S.A.).

(i) Nucleic Acid Molecules Encoding Proteins or Fragments thereof

Nucleic acid molecules of the present invention can comprise sequences that encode a transcription factor or fragment thereof. Such transcription factors or fragments thereof include homologues of known transcription factors in other organisms.

In a preferred embodiment of the present invention, a maize, soybean or *Arabidopsis thaliana* transcription factor or fragment thereof of the present invention is a homologue of another plant transcription factor. In another preferred embodiment of the present invention, a maize, soybean or *Arabidopsis thaliana* transcription factor or fragment thereof of the present invention is a homologue of a fungal transcription factor. In another preferred embodiment of the present invention, a maize, soybean or *Arabidopsis thaliana* transcription factor of the present invention is a homologue of mammalian transcription factor. In another preferred embodiment of the present invention, a maize, soybean or *Arabidopsis thaliana* transcription factor or fragment thereof of the present invention is a homologue of a bacterial transcription factor. In another preferred embodiment of the present invention, a maize, soybean or *Arabidopsis thaliana* transcription factor or fragment thereof of the present invention is a homologue of a maize transcription factor. In another preferred embodiment of the present invention, a maize, soybean or *Arabidopsis thaliana* transcription factor homologue or fragment thereof of the present invention is a homologue of a soybean transcription factor. In another preferred embodiment of the present invention, a maize, soybean or *Arabidopsis thaliana* transcription factor homologue or fragment thereof of the present invention is a homologue of an *Arabidopsis thaliana* transcription factor.

In a preferred embodiment of the present invention, the nucleic molecule of the present invention encodes a maize, soybean or *Arabidopsis thaliana* transcription factor or fragment thereof where a maize, soybean or *Arabidopsis thaliana* transcription factor exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a maize, soybean or *Arabidopsis thaliana* transcription factor or fragment thereof exhibits a % identity with its homologue of between about 25% and about 40%, more preferably of between about 40 and about 70%, even more preferably of between about 70% and about 90% and even more preferably between about 90% and 99%. In another preferred embodiment, of the present invention, a maize, soybean or *Arabidopsis thaliana* transcription factor or fragments thereof exhibits a % identity with its homologue of 100%.

In a preferred embodiment of the present invention, the nucleic molecule of the present invention encodes a maize, soybean or *Arabidopsis thaliana* transcription factor or fragment thereof where a maize, soybean or *Arabidopsis thaliana* transcription factor exhibits a BLAST score of greater than 120, preferably a BLAST score of between about 1450 and about 120, even more preferably a BLAST score of greater than 1450 with its homologue.

Nucleic acid molecules of the present invention also include non-maize, non-soybean homologues. Preferred non-homologues are selected from the group consisting of alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, *sorghum*, strawberry, sugarcane, sugarbeet, tomato, wheat, poplar, pine, fir, *eucalyptus*, apple, lettuce, lentils, grape, banana, tea, turf grasses, sunflower, oil palm and *Phaseolus*.

In a preferred embodiment, nucleic acid molecules having SEQ ID NO: 1 through SEQ ID NO: 3853 or complements and fragments of either can be utilized to obtain such homologues.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding a maize, soybean or *Arabidopsis thaliana* transcription factor or fragment thereof in SEQ ID NO: 1 through SEQ ID NO: 3853 due to the degeneracy in the genetic code in that they encode the same transcription factor but differ in nucleic acid sequence.

In another further aspect of the present invention, one or more of the nucleic acid molecules of the present invention differ in nucleic acid sequence from those encoding a maize, soybean or *Arabidopsis thaliana* transcription factor or fragment thereof in SEQ ID NO: 1 through SEQ ID NO: 3853 due to fact that the different nucleic acid sequence encodes a transcription factor having one or more conservative amino acid residue. Examples of conservative substitutions are set forth in Table 1. It is understood that codons capable of coding for such conservative substitutions are known in the art.

TABLE 1

| Original Residue | Conservative Substitutions |
| --- | --- |
| Ala | Ser |
| Arg | Lys |
| Asn | Gln; His |
| Asp | Glu |
| Cys | Ser; Ala |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

In a further aspect of the present invention, one or more of the nucleic acid molecules of the present invention differ in nucleic acid sequence from those encoding a maize, soybean or *Arabidopsis thaliana* transcription factor or fragment thereof set forth in SEQ ID NO: 1 through SEQ ID NO: 3853 or fragment thereof due to the fact that one or more codons encoding an amino acid has been substituted for a codon that encodes a nonessential substitution of the amino acid originally encoded.

Agents of the present invention include nucleic acid molecules that encode a maize, soybean or *Arabidopsis thaliana* transcription factor or fragment thereof and particularly substantially purified nucleic acid molecules selected from the group consisting of a nucleic acid molecule that encodes a maize, soybean or *Arabidopsis thaliana* homeobox transcription factor or fragment thereof, a nucleic acid molecule that encodes a maize, soybean or *Arabidopsis thaliana* HLH transcription factor or fragment thereof, a nucleic acid molecule that encodes a maize, soybean or *Arabidopsis thaliana* leucine zipper transcription factor or fragment thereof, a nucleic acid molecule that encodes a maize, soybean or *Arabidopsis thaliana* zinc finger transcription factor or fragment thereof and, a nucleic acid molecule that encodes a maize, soybean or *Arabidopsis thaliana* other transcription factor or fragment thereof.

Non-limiting examples of such nucleic acid molecules of the present invention are nucleic acid molecules comprising: SEQ ID NO: 1 through SEQ ID NO: 3853 or fragment thereof that encode for a plant transcription factor or fragment thereof, SEQ ID NO: 1 through SEQ ID NO: 49, SEQ ID NO 1415 through SEQ ID NO: 1555 and SEQ ID NO: 1746 through SEQ ID NO: 2000 or fragment thereof that encode for a homeobox transcription factor or fragment thereof, SEQ ID NO: 50 through SEQ ID NO: 65, SEQ ID NO: 1724 through SEQ ID NO: 1745 and SEQ ID NO: 2001 through SEQ ID NO: 2085 or fragment thereof that encode for a HLH transcription factor or fragment thereof, SEQ ID NO: 46 through SEQ ID NO: 47, SEQ ID NO: 66 through SEQ ID NO: 93, SEQ ID NO: 335, SEQ ID NO: 1475, SEQ ID NO: 1506, SEQ ID NO: 1523, SEQ ID NO: 1556 through SEQ ID NO: 1723, SEQ ID NO: 1752, SEQ ID NO: 1764, SEQ ID NO: 1771, SEQ ID NO: 1774, SEQ ID NO: 1804, SEQ ID NO: 1809 through SEQ ID NO: 1810, SEQ ID NO: 1822, SEQ ID NO: 1830, SEQ ID NO: 1840 through SEQ ID NO: 1845, SEQ ID NO: 1847 through 1854, SEQ ID NO: 1857 through 1862, SEQ ID NO: 1869, SEQ ID NO: 1878 through SEQ ID NO: 1879, SEQ ID NO: 1881 through SEQ ID NO: 1890, SEQ ID NO: 1892 through SEQ ID NO: 1896, SEQ ID NO: 1898 through SEQ ID NO: 1903, SEQ ID NO: 1905 through SEQ ID NO: 1907, SEQ ID NO: 1909 through SEQ ID NO: 1912, SEQ ID NO: 1932 through SEQ ID NO: 1938, SEQ ID NO: 1950 through SEQ ID NO: 1954, SEQ ID NO: 1959 through SEQ ID NO: 1961, SEQ ID NO: 1971 through SEQ ID NO: 1984, SEQ ID NO: 1990, SEQ ID NO: 1992 through SEQ ID NO: 1993, SEQ ID NO: 1995 through SEQ ID NO: 1998 and SEQ ID NO: 2086 through SEQ ID NO: 2275 or fragment thereof that encodes for a leucine zipper transcription factor or fragment thereof, SEQ ID NO: 94 through SEQ ID NO: 148, SEQ ID NO: 300 through SEQ ID NO: 596, SEQ ID NO: 2118 and SEQ ID NO: 2276 through SEQ ID NO: 2686 or fragment thereof that encode for a zinc finger transcription factor or fragment thereof and SEQ ID NO: 149 through SEQ ID NO: 299, SEQ ID NO: 597 through SEQ ID NO: 1414 and SEQ ID NO: 2687 through SEQ ID NO: 3853or fragment thereof that encode for an other transcription factor or fragment thereof.

A nucleic acid molecule of the present invention can also encode an homologue of a maize, soybean or *Arabidopsis thaliana* homeobox transcription factor or fragment thereof, a maize, soybean or *Arabidopsis thaliana* HLH transcription factor, a maize, soybean or *Arabidopsis thaliana* leucine zipper transcription factor, a maize, soybean or *Arabidopsis thaliana* zinc finger transcription factor, or fragment thereof or a maize, soybean or *Arabidopsis thaliana* other transcription factor or fragment thereof. As used herein a homologue protein molecule or fragment thereof is a counterpart protein molecule or fragment thereof in a second species (e.g., maize homeobox transcription factor is a homologue of *Arabidopsis*' homeobox transcription factor).

(ii) Nucleic Acid Molecule Markers and Probes

One aspect of the present invention concerns markers that include nucleic acid molecules SEQ ID NO: 1 through SEQ ID NO: 3853 or complements thereof or fragments of either that can act as markers or other nucleic acid molecules of the present invention that can act as markers. Genetic markers of the present invention include "dominant" or "codominant" markers "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a results of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al, *Nature* 313:495-498 (1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad. Sci.* (*U.S.A.*) 86:2757-2760 (1989), the entirety of which is herein incorporated by reference), ligase chain reaction (Barany, *Proc. Natl. Acad. Sci.* (*U.S.A.*) 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TaqMan assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7: 378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits*, 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (www-genome.wi.mit.edu/cgi-bin/primer/primer3.cgi), STSPipeline (www-genome.wi.mit.edu/cgi-bin/www-STS_Pipeline), or GeneUp (Pesole et al., *BioTech-*

*niques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or fragments thereof or peptide molecules encoded by SEQ ID NO: 1 through SEQ ID NO: 3853 or one or more of the protein or fragment thereof and peptide molecules encoded by other nucleic acid agents of the present invention. As used herein, the term "protein molecule" or "peptide molecule" includes any molecule that comprises five or more amino acids. It is well known in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine and homoserine.

Non-limiting examples of the protein or fragment thereof of the present invention include a maize, soybean or *Arabidopsis thaliana* transcription factor or fragment thereof; a maize, soybean or *Arabidopsis thaliana* homeobox transcription factor or fragment thereof, a maize, soybean or *Arabidopsis thaliana* HLH transcription factor or fragment thereof, a maize, soybean or *Arabidopsis thaliana* leucine zipper transcription factor or fragment thereof, a maize, soybean or *Arabidopsis thaliana* zinc finger transcription factor or fragment thereof or a maize, soybean or *Arabidopsis thaliana* other transcription factor or fragment thereof, Non-limiting examples of the protein or fragment molecules of the present invention are a transcription factor or fragment thereof encoded by: SEQ ID NO: 1 through SEQ ID NO: 3853 or fragment thereof that encode for a transcription factor or fragment thereof, SEQ ID NO: 1 through SEQ ID NO: 49, SEQ ID NO 1415 through SEQ ID NO: 1555 and SEQ ID NO: 1746 through SEQ ID NO: 2000 or fragment thereof that encode for a homeobox transcription factor or fragment thereof, SEQ ID NO: 50 through SEQ ID NO: 65, SEQ ID NO: 1724 through SEQ ID NO: 1745 and SEQ ID NO: 2001 through SEQ ID NO: 2085 or fragment thereof that encode for a HLH transcription factor or fragment thereof, SEQ ID NO: 46 through SEQ ID NO: 47, SEQ ID NO: 66 through SEQ ID NO: 93, SEQ ID NO: 335, SEQ ID NO: 1475, SEQ ID NO: 1506, SEQ ID NO: 1523, SEQ ID NO: 1556 through SEQ ID NO: 1723, SEQ ID NO: 1752, SEQ ID NO: 1764, SEQ ID NO: 1771, SEQ ID NO: 1774, SEQ ID NO: 1804, SEQ ID NO: 1809 through SEQ ID NO: 1810, SEQ ID NO: 1822, SEQ ID NO: 1830, SEQ ID NO: 1840 through SEQ ID NO: 1845, SEQ ID NO: 1847 through 1854, SEQ ID NO: 1857 through 1862, SEQ ID NO: 1869, SEQ ID NO: 1878 through SEQ ID NO: 1879, SEQ ID NO: 1881 through SEQ ID NO: 1890, SEQ ID NO: 1892 through SEQ ID NO: 1896, SEQ ID NO: 1898 through SEQ ID NO: 1903, SEQ ID NO: 1905 through SEQ ID NO: 1907, SEQ ID NO: 1909 through SEQ ID NO: 1912, SEQ ID NO: 1932 through SEQ ID NO: 1938, SEQ ID NO: 1950 through SEQ ID NO: 1954, SEQ ID NO: 1959 through SEQ ID NO: 1961, SEQ ID NO: 1971 through SEQ ID NO: 1984, SEQ ID NO: 1990, SEQ ID NO: 1992 through SEQ ID NO: 1993, SEQ ID NO: 1995 through SEQ ID NO: 1998 and SEQ ID NO: 2086 through SEQ ID NO: 2275 or fragment thereof that encode for a leucine zipper transcription factor or fragment thereof, SEQ ID NO: 94 through SEQ ID NO: 148, SEQ ID NO: 300 through SEQ ID NO: 596, SEQ ID NO: 2118 and SEQ ID NO: 2276 through SEQ ID NO: 2686 or fragment thereof that encode for a zinc finger transcription factor or fragment thereof, and SEQ ID NO: 149 through SEQ ID NO: 299, SEQ ID NO: 597 through SEQ ID NO: 1414 and SEQ ID NO: 2687 through SEQ ID NO: 3853 or fragment thereof that encode for an other transcription factor or fragment thereof.

One or more of the protein or fragment of peptide molecules may be produced via chemical synthesis, or more preferably, by expressing in a suitable bacterial or eucaryotic host. Suitable methods for expression are described by Sambrook et al., (In: *Molecular Cloning, A Laboratory Manual, 2nd Edition, Cold Spring Harbor Press*, Cold Spring Harbor, N.Y. (1989)), or similar texts. For example, the protein may be expressed in, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecules of the present invention are preferably produced via recombinant means.

Another class of agents comprise protein or peptide molecules or fragments or fusions thereof encoded by SEQ ID NO: 1 through SEQ ID NO: 3853 or complements thereof in which conservative, non-essential or non-relevant amino acid residues have been added, replaced or deleted. Computerized means for designing modifications in protein structure are known in the art (Dahiyat and Mayo, *Science* 278:82-87 (1997), the entirety of which is herein incorporated by reference).

The protein molecules of the present invention include plant homologue proteins. An example of such a homologue is a homologue protein of a non-maize or non soybean plant species, that include but not limited to alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, *sorghum*, strawberry, sugarcane, sugarbeet, tomato, wheat, poplar, pine, fir, *eucalyptus*, apple, lettuce, lentils, grape, banana, tea, turf grasses, sunflower, oil palm, *Phaseolus* etc. Particularly preferred non-maize or non-soybean for use for the isolation of homologs would include, *Arabidopsis*, barley, cotton, oat, oilseed rape, rice, canola, ornamentals, sugarcane, sugarbeet, tomato, potato, wheat and turf grasses. Such a homologue can be obtained by any of a variety of methods. Most preferably, as indicated above, one or more of the disclosed sequences (SEQ ID NO: 1 through SEQ ID NO: 3853 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal and may comprise intact immunoglobulins, or antigen binding portions of immunoglobulins fragments (such as (F(ab'), F(ab')$_2$), or single-chain immunoglobulins producible, for example, via recombinant means. It is understood that practitioners are familiar with the standard resource materials which describe specific conditions and procedures for the construction, manipulation and isolation of antibodies (see, for example, Harlow and Lane, In: *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 µg of purified protein (or fragment thereof) that has been emulsified in a suitable adjuvant (such as TiterMax adjuvant (Vaxcel, Norcross, Ga.)). Immunization is preferably conducted at two intramuscular sites, one intraperitoneal site and one subcutaneous site at the base of the tail. An additional i.v. injection of approximately 25 µg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 µg of the same protein or fragment. The splenic leukocytes from this animal may be recovered 3 days later and then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs"), preferably by direct ELISA.

In one embodiment, anti-protein or peptide monoclonal antibodies are isolated using a fusion of a protein or peptide of the present invention, or conjugate of a protein or peptide of the present invention, as immunogens. Thus, for example, a group of mice can be immunized using a fusion protein emulsified in Freund's complete adjuvant (e.g. approximately 50 µg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96 well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbor cells. Desirably, the fusion plates are screened several times since the rates of hybridoma growth vary. In a preferred sub-embodiment, a different antigenic form may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

Nucleic acid molecules and fragments thereof of the present invention may be employed to obtain other nucleic acid molecules from the same species (e.g., ESTs or fragment thereof from maize may be utilized to obtain other nucleic acid molecules from maize). Such nucleic acid molecules include the nucleic acid molecules that encode the complete coding sequence of a protein and promoters and flanking sequences of such molecules. In addition, such nucleic acid molecules include nucleic acid molecules that encode for other isozymes or gene family members. Such molecules can be readily obtained by using the above-described nucleic acid molecules or fragments thereof to screen cDNA or genomic libraries obtained from maize or soybean. Methods for forming such libraries are well known in the art.

Nucleic acid molecules and fragments thereof of the present invention may also be employed to obtain nucleic acid homologues. Such homologues include the nucleic acid molecule of other plants or other organisms (e.g., alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, *sorghum*, strawberry, sugarcane, sugarbeet, tomato, wheat, poplar, pine, fir, *eucalyptus*, apple, lettuce, lentils, grape, banana, tea, turf grasses, sunflower, oil palm, *Phaseolus*, etc.) including the nucleic acid molecules that encode, in whole or in part, protein homologues of other plant species or other organisms, sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO: 1 through SEQ ID NO: 3853 or complements thereof because complete complementarity is not needed for stable hybridization. The nucleic acid molecules of the present invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci.* (*U.S.A.*) 83:4143-4146 (1986), the entirety of which is herein incorporated by reference; Goodchild et al., *Proc. Natl. Acad. Sci.* (*U.S.A.*) 85:5507-5511 (1988), the entirety of which is herein incorporated by reference; Wickstrom et al., *Proc. Natl. Acad. Sci.* (*U.S.A.*) 85:1028-1032 (1988), the entirety of which is herein incorporated by reference; Holt et al., *Molec. Cell. Biol.* 8:963-973 (1988), the entirety of which is herein incorporated by reference; Gerwirtz et al., *Science* 242:1303-1306 (1988), the entirety of which is herein incorporated by reference; Anfossi et al., *Proc. Natl. Acad. Sci.* (*U.S.A.*) 86:3379-3383 (1989), the entirety of which is herein incorporated by reference; Becker et al., *EMBO J.* 8:3685-3691 (1989); the entirety of which is herein incorporated by reference). Automated nucleic acid synthesizers may be employed for this purpose. In lieu of such synthesis, the disclosed nucleic acid molecules may be used to define a pair of primers that can be used with the polymerase chain reaction (Mullis et al., *Cold Spring Harbor Symp. Quant. Biol.* 51:263-273 (1986); Erlich et al., European Patent 50,424; European Patent 84,796; European Patent 258,017; European Patent 237,362; Mullis, European Patent 201,184; Mullis et al., U.S. Pat. No. 4,683,202; Erlich, U.S. Pat. No. 4,582,788; and Saiki et al., U.S. Pat. No. 4,683,194, all of which are herein incorporated by reference in their entirety) to amplify and obtain any desired nucleic acid molecule or fragment.

Promoter sequence(s) and other genetic elements, including but not limited to transcriptional regulatory flanking sequences, associated with one or more of the disclosed nucleic acid sequences can also be obtained using the disclosed nucleic acid sequence provided herein. In one embodiment, such sequences are obtained by incubating EST nucleic acid molecules or preferably fragments thereof with members of genomic libraries (e.g. maize and soybean) and recovering clones that hybridize to the EST nucleic acid molecule or fragment thereof. In a second embodiment, methods of "chromosome walking," or inverse PCR may be used to obtain such sequences (Frohman et al., *Proc. Natl. Acad. Sci.* (*U.S.A.*) 85:8998-9002 (1988); Ohara et al., *Proc. Natl. Acad. Sci.* (*U.S.A.*) 86:5673-5677 (1989); Pang et al., *Biotechniques* 22:1046-1048 (1977); Huang et al., *Methods Mol. Biol.* 69:89-96 (1997); Huang et al., *Method Mol. Biol.* 67:287-294 (1997); Benkel et al., *Genet. Anal.* 13:123-127 (1996); Hartl et al., *Methods Mol. Biol.* 58:293-301 (1996), all of which are herein incorporated by reference in their entirety).

The nucleic acid molecules of the present invention may be used to isolate promoters of cell enhanced, cell specific, tissue enhanced, tissue specific, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et al., *Genome Analysis: Analyzing DNA*, 1, (1997), Cold Spring Harbor Laboratory Press, Cold Spring Harbor, N.Y., the entirety of which is herein incorporated by reference). Promoters obtained utilizing the nucleic acid molecules of the present invention could also be modified to affect their control characteristics. Examples of such modifications would include but are not limited to enhanced sequences as reported in Uses of the Agents of the Invention, Section (a) Plant Constructs and Plant Transformants. Such genetic elements could be used to enhance gene expression of new and existing traits for crop improvements.

In one sub-aspect, such an analysis is conducted by determining the presence and/or identity of polymorphism(s) by one or more of the nucleic acid molecules of the present invention and more preferably one or more of the EST nucleic acid molecule or fragment thereof which are associated with a phenotype, or a predisposition to that phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s) and more preferably within 100 kb of the polymorphism(s) and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist and the polymorphism is thus said to be di-allelic. In other cases, the species' population may contain multiple alleles and the polymorphism is termed tri-allelic, etc. A single gene may have multiple different unrelated polymorphisms. For example, it may have a di-allelic polymorphism at one site and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour et al., FEBS Lett. 307:113-115 (1992); Jones et al., Eur. J. Haematol. 39:144-147 (1987); Horn et al., PCT Patent Application WO91/14003; Jeffreys, European Patent Application 370,719; Jeffreys, U.S. Pat. No. 5,175,082; Jeffreys et al., Amer. J. Hum. Genet. 39:11-24 (1986); Jeffreys et al., Nature 316:76-79 (1985); Gray et al., Proc. R. Acad. Soc. Lond. 243:241-253 (1991); Moore et al., Genomics 10:654-660 (1991); Jeffreys et al., Anim. Genet. 18:1-15 (1987); Hillel et al., Anim. Genet. 20:145-155 (1989); Hillel et al., Genet. 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis et al., Cold Spring Harbor Symp. Quant. Biol. 51:263-273 (1986); Erlich et al., European Patent Appln. 50,424; European Patent Appln. 84,796; European Patent Application 258,017; European Patent Appln. 237,362; Mullis, European Patent Appln. 201,184; Mullis et al., U.S. Pat. No. 4,683,202; Erlich, U.S. Pat. No. 4,582,788; and Saiki et al., U.S. Pat. No. 4,683,194), using primer pairs that are capable of hybridizing to the proximal sequences that define a polymorphism in its double-stranded form.

In lieu of PCR, alternative methods, such as the "Ligase Chain Reaction" ("LCR") may be used (Barany, Proc. Natl. Acad. Sci. (U.S.A.) 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren et al., Science 241:1077-1080 (1988), the entirety of which is herein incorporated by reference). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson et al., have described a nucleic acid detection assay that combines attributes of PCR and OLA (Nickerson et al., Proc. Natl. Acad. Sci. (U.S.A.) 87:8923-8927 (1990), the entirety of which is herein incorporated by reference). In this method, PCR is used to achieve the exponential amplification of target DNA, which is then detected using OLA. In addition to requiring multiple and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu et al., Genomics 4:560-569 (1989), the entirety of which is herein incorporated by reference) and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek et al., U.S. Pat. No. 5,130,238; Davey et al., European Patent Application 329,822; Schuster et al., U.S. Pat. No. 5,169,766; Miller et al., PCT Patent Application WO 89/06700; Kwoh et al., Proc. Natl. Acad. Sci. (U.S.A.) 86:1173-1177 (1989); Gingeras et al., PCT Patent Application WO 88/10315; Walker et al., Proc. Natl. Acad. Sci. (U.S.A.) 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick et al., Cytogen. Cell Genet. 32:58-67 (1982); Botstein et al, Ann. J. Hum. Genet. 32:314-331 (1980); Fischer et al., (PCT Application WO90/13668); Uhlen, PCT Application WO90/11369).

Polymorphisms can also be identified by Single Strand Conformation Polymorphism (SSCP) analysis. SSCP is a method capable of identifying most sequence variations in a single strand of DNA, typically between 150 and 250 nucleotides in length (Elles, Methods in Molecular Medicine: Molecular Diagnosis of Genetic Diseases, Humana Press (1996), the entirety of which is herein incorporated by reference); Orita et al., Genomics 5:874-879 (1989), the entirety of which is herein incorporated by reference). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to, Lee et al., *Anal. Biochem.* 205:289-293 (1992), the entirety of which is herein incorporated by reference; Suzuki et al., *Anal. Biochem.* 192:82-84 (1991), the entirety of which is herein incorporated by reference; Lo et al., *Nucleic Acids Research* 20:1005-1009 (1992), the entirety of which is herein incorporated by reference; Sarkar et al., *Genomics* 13:441-443 (1992), the entirety of which is herein incorporated by reference. It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA (Vos et al., *Nucleic Acids Res.* 23:4407-4414 (1995), the entirety of which is herein incorporated by reference). This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on Salix (Beismann et al., *Mol. Ecol.* 6:989-993 (1997), the entirety of which is herein incorporated by reference), *Acinetobacter* (Janssen et al., *Int. J. Syst. Bacteriol.* 47:1179-1187 (1997), the entirety of which is herein incorporated by reference), *Aeromonas popoffi* (Huys et al., *Int. J. Syst. Bacteriol.* 47:1165-1171 (1997), the entirety of which is herein incorporated by reference), rice (McCouch et al., *Plant Mol. Biol.* 35:89-99 (1997), the entirety of which is herein incorporated by reference; Nandi et al., *Mol. Gen. Genet.* 255:1-8 (1997), the entirety of which is herein incorporated by reference; Cho et al., *Genome* 39:373-378 (1996), the entirety of which is herein incorporated by reference), barley (*Hordeum vulgare*)(Simons et al., *Genomics* 44:61-70 (1997), the entirety of which is herein incorporated by reference; Waugh et al., *Mol. Gen. Genet.* 255:311-321 (1997), the entirety of which is herein incorporated by reference; Qi et al., *Mol. Gen Genet.* 254:330-336 (1997), the entirety of which is herein incorporated by reference; Becker et al., *Mol. Gen. Genet.* 249:65-73 (1995), the entirety of which is herein incorporated by reference), potato (Van der Voort et al., *Mol. Gen. Genet.* 255:438-447 (1997), the entirety of which is herein incorporated by reference; Meksem et al., *Mol. Gen. Genet.* 249:74-81 (1995), the entirety of which is herein incorporated by reference), *Phytophthora infestans* (Van der Lee et al., *Fungal Genet. Biol.* 21:278-291 (1997), the entirety of which is herein incorporated by reference), *Bacillus anthracis* (Keim et al., *J. Bacteriol* 179:818-824 (1997), the entirety of which is herein incorporated by reference), *Astragalus cremnophylax* (Travis et al., *Mol. Ecol.* 5:735-745 (1996), the entirety of which is herein incorporated by reference), *Arabidopsis* (Cnops et al., *Mol. Gen. Genet.* 253:32-41 (1996), the entirety of which is herein incorporated by reference), *Escherichia coli* (Lin et al., *Nucleic Acids Res.* 24:3649-3650 (1996), the entirety of which is herein incorporated by reference), *Aeromonas* (Huys et al., *Int. J. Syst. Bacteriol.* 46:572-580 (1996), the entirety of which is herein incorporated by reference), nematode (Folkertsma et al., *Mol. Plant Microbe Interact.* 9:47-54 (1996), the entirety of which is herein incorporated by reference), tomato (Thomas et al., *Plant J.* 8:785-794 (1995), the entirety of which is herein incorporated by reference) and human (Latorra et al., *PCR Methods Appl.* 3:351-358 (1994), the entirety of which is herein incorporated by reference). AFLP analysis has also been used for fingerprinting mRNA (Money et al., *Nucleic Acids Res.* 24:2616-2617 (1996), the entirety of which is herein incorporated by reference; Bachem et al., *Plant J.* 9:745-753 (1996), the entirety of which is herein incorporated by reference). It is understood that one or more of the nucleic acids of the present invention, may be utilized as markers or probes to detect polymorphisms by AFLP analysis or for fingerprinting RNA.

Polymorphisms may also be found using random amplified polymorphic DNA (RAPD) (Williams et al., *Nuc. Acids Res.* 18:6531-6535 (1990), the entirety of which is herein incorporated by reference) and cleaveable amplified polymorphic sequences (CAPS) (Lyamichev et al., *Science* 260:778-783 (1993), the entirety of which is herein incorporated by reference). It is understood that one or more of the nucleic acid molecules of the present invention, may be utilized as markers or probes to detect polymorphisms by RAPD or CAPS analysis.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$(MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Arús and Moreno-González, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which is herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Starn, *Genetics* 136:1447-1455 (1994), the entirety of which is herein incorporated by reference and Zeng, *Genetics* 136:1457-1468 (1994) the entirety of which is herein incorporated by reference. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp. 195-204 (1994), the entirety of which is herein incorporated by reference, thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping populations is important to map construction. The choice of appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Linkage in Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequillibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci.* (*U.S.A.*) 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci.* (*U.S.A.*) 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci.* (*U.S.A.*) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plants cells or tissues. Any source of nucleic acid may be used. Preferably, the nucleic acid is genomic DNA. The nucleic acid is subjected to restriction endonuclease digestion. For example, one or more nucleic acid molecule or fragment thereof of the present invention can be used as a probe in accordance with the above-described polymorphic methods. The polymorphism obtained in this approach can then be cloned to identify the mutation at the coding region which alters the protein's structure or regulatory region of the gene which affects its expression level.

In an aspect of the present invention, one or more of the nucleic molecules of the present invention are used to determine the level (i.e., the concentration of mRNA in a sample, etc.) in a plant (preferably maize or soybean) or pattern (i.e., the kinetics of expression, rate of decomposition, stability profile, etc.) of the expression of a protein encoded in part or whole by one or more of the nucleic acid molecule of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether an Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance such as tolerance to abiotic stress, male sterility, quality improvement or yield etc.). A change in genotype or phenotype may be transient or permanent. Also as used herein, a tissue sample is any sample that comprises more than one cell. In a preferred aspect, a tissue sample comprises cells that share a common characteristic (e.g. derived from root, seed, flower, leaf, stem or pollen etc.).

In one aspect of the present invention, an evaluation can be conducted to determine whether a particular mRNA molecule is present. One or more of the nucleic acid molecules of the present invention, preferably one or more of the EST nucleic acid molecules or fragments thereof of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101:477-484 (1984), the entirety of which is herein incorporated by reference; Angerer et al., *Dev. Biol.* 112:157-166 (1985), the entirety of which is herein incorporated by reference; Dixon et al., *EMBO J.* 10:1317-1324 (1991), the entirety of which is herein incorporated by reference). In situ hybridization may be used to measure the steady-state level of RNA accumulation. It is a sensitive technique and RNA sequences present in as few as 5-10 copies per cell can be detected (Hardin et al., *J. Mol. Biol.* 202:417-431 (1989), the entirety of which is herein incorporated by reference). A number of protocols have been devised for in situ hybridization, each with tissue preparation, hybridization and washing conditions (Meyerowitz, *Plant Mol. Biol. Rep.* 5:242-250 (1987), the entirety of which is herein incorporated by reference; Cox and Goldberg, In: *Plant Molecular Biology: A Practical Approach*, Shaw (ed.), pp 1-35, IRL Press, Oxford (1988), the entirety of which is herein incorporated by reference; Raikhel et al., *In situ RNA hybridization in plant tissues*, In: *Plant Molecular Biology Manual*, vol. B9:1-32, Kluwer Academic Publisher, Dordrecht, Belgium (1989), the entirety of which is herein incorporated by reference).

In situ hybridization also allows for the localization of proteins within a tissue or cell (Wilkinson, *In Situ Hybridization*, Oxford University Press, Oxford (1992), the entirety of which is herein incorporated by reference; Langdale, *In Situ Hybridization* In: *The Maize Handbook*, Freeling and Walbot (eds.), pp 165-179, Springer-Verlag, N.Y. (1994), the entirety of which is herein incorporated by reference). It is understood that one or more of the molecules of the present invention, preferably one or more of the EST nucleic acid molecules or fragments thereof of the present invention or one or more of the antibodies of the present invention may be utilized to detect the level or pattern of a transcription factor or mRNA thereof by in situ hybridization.

Fluorescent in situ hybridization allows the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17:101-109 (1991), the entirety of which is herein incorporated by reference; Gustafson et al., *Proc. Natl. Acad. Sci. (U.S.A.)* 87:1899-1902 (1990), herein incorporated by reference; Mukai and Gill, *Genome* 34:448-452 (1991), the entirety of which is herein incorporated by reference; Schwarzacher and Heslop-Harrison, *Genome* 34:317-323 (1991); Wang et al., *Jpn. J. Genet.* 66:313-316 (1991), the entirety of which is herein incorporated by reference; Parra and Windle, *Nature Genetics* 5:17-21 (1993), the entirety of which is herein incorporated by reference). It is understood that the nucleic acid molecules of the present invention may be used as probes or markers to localize sequences along a chromosome.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of a tissue is pressed gently onto nitrocellulose paper, nylon membrane or polyvinylidene difluoride membrane. Such membranes are commercially available (e.g. Millipore, Bedford, Mass. U.S.A.). The contents of the cut cell transfer onto the membrane and the contents and are immobilized to the membrane. The immobilized contents form a latent print that can be visualized with appropriate probes. When a plant tissue print is made on nitrocellulose paper, the cell walls leave a physical print that makes the anatomy visible without further treatment (Varner and Taylor, *Plant Physiol.* 91:31-33 (1989), the entirety of which is herein incorporated by reference).

Tissue printing on substrate films is described by Daoust, *Exp. Cell Res.* 12:203-211 (1957), the entirety of which is herein incorporated by reference, who detected amylase, protease, ribonuclease and deoxyribonuclease in animal tissues using starch, gelatin and agar films. These techniques can be applied to plant tissues (Yomo and Taylor, *Planta* 112:35-43 (1973); the entirety of which is herein incorporated by reference; Harris and Chrispeels, *Plant Physiol.* 56:292-299 (1975), the entirety of which is herein incorporated by reference). Advances in membrane technology have increased the range of applications of Daoust's tissue-printing techniques allowing (Cassab and Varner, *J. Cell. Biol.* 105:2581-2588 (1987), the entirety of which is herein incorporated by reference) the histochemical localization of various plant enzymes and deoxyribonuclease on nitrocellulose paper and nylon (Spruce et al., *Phytochemistry* 26:2901-2903 (1987), the entirety of which is herein incorporated by reference; Barres et al., *Neuron* 5:527-544 (1990), the entirety of which is herein incorporated by reference; Reid and Pont-Lezica, *Tissue Printing: Tools for the Study of Anatomy, Histochemistry and Gene Expression*, Academic Press, New York, N.Y. (1992), the entirety of which is herein incorporated by reference; Reid et al., *Plant Physiol.* 93:160-165 (1990), the entirety of which is herein incorporated by reference; Ye et al., *Plant J.* 1:175-183 (1991), the entirety of which is herein incorporated by reference).

It is understood that one or more of the molecules of the present invention, preferably one or more of the EST nucleic acid molecules or fragments thereof of the present invention or one or more of the antibodies of the present invention may be utilized to detect the presence or quantity of a transcription factor by tissue printing.

Further it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) of a molecule, cell, tissue or plant. As used herein, a marker nucleic acid is a nucleic acid molecule that is utilized to determine an attribute or feature (e.g. presence or absence, location, correlation, etc.) or a molecule, cell, tissue or plant.

A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270:467-470 (1995), the entirety of which is herein incorporated by reference; Shalon, Ph.D. Thesis, Stanford University (1996), the entirety of which is herein incorporated by reference). Every nucleotide in a large sequence can be queried at the same time. Hybridization can be used to efficiently analyze nucleotide sequences.

Several microarray methods have been described. One method compares the sequences to be analyzed by hybridization to a set of oligonucleotides representing all possible subsequences (Bains and Smith, *J. Theor. Biol.* 135:303-307 (1989), the entirety of which is herein incorporated by reference). A second method hybridizes the sample to an array of oligonucleotide or cDNA molecules. An array consisting of oligonucleotides complementary to subsequences of a target sequence can be used to determine the identity of a target sequence, measure its amount and detect differences between the target and a reference sequence. Nucleic acid molecules microarrays may also be screened with protein molecules or fragments thereof to determine nucleic acid molecules that specifically bind protein molecules or fragments thereof.

The microarray approach may be used with polypeptide targets (U.S. Pat. Nos. 5,445,934; 5,143,854; 5,079,600; 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. (Fodor et al., *Science* 251:767-773 (1991), the entirety of which is herein incorporated by reference). It is understood that one or more of the nucleic acid molecules or protein or fragments thereof of the present invention may be utilized in a microarray based method.

In a preferred embodiment of the present invention microarrays may be prepared that comprise nucleic acid molecules where such nucleic acid molecules encode at least one, preferably at least two, more preferably at least three transcription factors. In a preferred embodiment the nucleic acid molecules are selected from the group consisting of a nucleic acid molecule that encodes a maize, soybean or *Arabidopsis thaliana* homeobox transcription factor or fragment thereof, a nucleic acid molecule that encodes a maize, soybean or *Arabidopsis thaliana* HLH transcription factor or fragment thereof, a nucleic acid molecule that encodes a maize, soybean or *Arabidopsis thaliana* leucine zipper transcription factor or fragment thereof, a nucleic acid molecule that encodes a maize, soybean or *Arabidopsis thaliana* zinc finger transcription factor or fragment thereof and a nucleic acid molecule that encodes a maize, soybean or *Arabidopsis thaliana* other transcription factor or fragment thereof.

Site directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site directed mutagenesis are often employed. These are cassette mutagenesis (Wells et al., *Gene* 34:315-323 (1985), the entirety of which is herein incorporated by reference), primer extension (Gilliam et al., *Gene* 12:129-137 (1980), the entirety of which is herein incorporated by reference; Zoller and Smith, *Methods Enzymol.* 100:468-500 (1983), the entirety of which is herein incorporated by reference; Dalbadie-McFarland et al., *Proc. Natl. Acad. Sci.* (*U.S.A.*) 79:6409-6413 (1982), the entirety of which is herein incorporated by reference) and methods based upon PCR (Scharf et al., *Science* 233:1076-1078 (1986), the entirety of which is herein incorporated by reference; Higuchi et al., *Nucleic Acids Res.* 16:7351-7367 (1988), the entirety of which is herein incorporated by reference). Site directed mutagenesis approaches are also described in European Patent 0 385 962, the entirety of which is herein incorporated by reference; European Patent 0 359 472, the entirety of which is herein incorporated by reference; and PCT Patent Application WO 93/07278, the entirety of which is herein incorporated by reference.

Site directed mutagenesis strategies have been applied to plants for both in vitro as well as in vivo site directed mutagenesis (Lanz et al., *J. Biol. Chem.* 266:9971-9976 (1991), the entirety of which is herein incorporated by reference; Kovgan and Zhdanov, *Biotekhnologiya* 5:148-154; No. 207160n, Chemical Abstracts 110:225 (1989), the entirety of which is herein incorporated by reference; Ge et al., *Proc. Natl. Acad. Sci. (U.S.A.)* 86:4037-4041 (1989), the entirety of which is herein incorporated by reference; Zhu et al., *J. Biol. Chem.* 271: 18494-18498 (1996), the entirety of which is herein incorporated by reference; Chu et al., *Biochemistry* 33:6150-6157 (1994), the entirety of which is herein incorporated by reference; Small et al., *EMBO J.* 11:1291-1296 (1992), the entirety of which is herein incorporated by reference; Cho et al., *Mol. Biotechnol.* 8:13-16 (1997), the entirety of which is herein incorporated by reference; Kita et al., *J. Biol. Chem.* 271:26529-26535 (1996), the entirety of which is herein incorporated by reference; Jin et al., *Mol. Microbiol.* 7:555-562 (1993), the entirety of which is herein incorporated by reference; Hatfield and Vierstra, *J. Biol. Chem.* 267:14799-14803 (1992), the entirety of which is herein incorporated by reference; Zhao et al., *Biochemistry* 31:5093-5099 (1992), the entirety of which is herein incorporated by reference).

Any of the nucleic acid molecules of the present invention may either be modified by site directed mutagenesis or used as, for example, nucleic acid molecules that are used to target other nucleic acid molecules for modification. It is understood that mutants with more than one altered nucleotide can be constructed using techniques that practitioners are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), the entirety of which is herein incorporated by reference) and molecular biochemical approaches, including the screening of recombinant cDNA libraries with antibodies (Landschulz et al., *Genes Dev.* 2:786-800 (1988), the entirety of which is herein incorporated by reference) or DNA probes (Bodner et al., *Cell* 55:505-518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4:839-849 (1992), the entirety of which is herein incorporated by reference; Schindler et al., *EMBO J.* 11:1261-1273 (1992), the entirety of which is herein incorporated by reference). An in situ screening protocol does not require the purification of the protein of interest (Vinson et al., *Genes Dev.* 2:801-806 (1988), the entirety of which is herein incorporated by reference; Singh et al., *Cell* 52:415-423 (1988), the entirety of which is herein incorporated by reference).

Two steps may be employed to characterize DNA-protein interactions. The first is to identify promoter fragments that interact with DNA-binding proteins, to titrate binding activity, to determine the specificity of binding and to determine whether a given DNA-binding activity can interact with related DNA sequences (Sambrook et al., *Molecular Cloning: A Laboratory Manual*, $2^{nd}$ edition, Cold Spring Harbor Laboratory Press, Cold Spring Harbor, N.Y. (1989)). Electrophoretic mobility-shift assay is a widely used assay. The assay provides a rapid and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9:6505-6525 (1981), the entirety of which is herein incorporated by reference). When one or more specific binding activities have been identified, the exact sequence of the DNA bound by the protein may be determined. Several procedures for characterizing protein/DNA-binding sites are used, including methylation and ethylation interference assays (Maxam and Gilbert, *Methods Enzymol.* 65:499-560 (1980), the entirety of which is herein incorporated by reference; Wissman and Hillen, *Methods Enzymol.* 208:365-379 (1991), the entirety of which is herein incorporated by reference), footprinting techniques employing DNase I (Galas and Schmitz, *Nucleic Acids Res.* 5:3157-3170 (1978), the entirety of which is herein incorporated by reference), 1,10-phenanthroline-copper ion methods (Sigman et al., *Methods Enzymol.* 208:414-433 (1991), the entirety of which is herein incorporated by reference) and hydroxyl radicals methods (Dixon et al., *Methods Enzymol.* 208:414-433 (1991), the entirety of which is herein incorporated by reference). It is understood that one or more of the nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

A two-hybrid system is based on the fact that many cellular functions are carried out by proteins, such as transcription factors, that interact (physically) with one another. Two-hybrid systems have been used to probe the function of new proteins (Chien et al., *Proc. Natl. Acad. Sci. (U.S.A.)* 88:9578-9582 (1991) the entirety of which is herein incorporated by reference; Durfee et al., *Genes Dev.* 7:555-569 (1993) the entirety of which is herein incorporated by reference; Choi et al., *Cell* 78:499-512 (1994), the entirety of which is herein incorporated by reference; Kranz et al., *Genes Dev.* 8:313-327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci. (U.S.A.)* 91:12098-12984 (1994), the entirety of which is herein incorporated by reference), larger sets of hundreds of proteins (Bendixen et al., *Nucl. Acids Res.* 22:1778-1779 (1994), the entirety of which is herein incorporated by reference) and to comprehensively map proteins encoded by a small genome (Bartel et al., *Nature Genetics* 12:72-77 (1996), the entirety of which is herein incorporated by reference). This technique utilizes proteins fused to the DNA-binding domain and proteins fused to the activation domain. They are expressed in two different haploid yeast strains of opposite mating type and the strains are mated to determine if the two proteins interact. Mating occurs when haploid yeast strains come into contact and result in the fusion of the two haploids into a diploid yeast strain. An interaction can be determined by the activation of a two-hybrid reporter gene in the diploid strain. An advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

(a) Plant Constructs and Plant Transformants

One or more of the nucleic acid molecules of the present invention may be used in plant transformation or transfection. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including, but not limited to maize (pp 63-69), soybean (pp 50-60), Arabidopsis (p 45), phaseolus (pp 47-49), peanut (pp 49-50), alfalfa (p 60), wheat (pp 69-71), rice (pp 72-79), oat (pp 80-81), sorghum (p 83), rye (p 84), tritordeum (p 84), millet (p85), fescue (p 85), perennial ryegrass (p 86), sugarcane (p87), cranberry (p101), papaya (pp 101-102), banana (p 103), banana (p 103), muskmelon (p 104), apple (p 104), cucumber (p 105), dendrobium (p 109), gladiolus (p 110), chrysanthemum (p 110), liliacea (p 111), cotton (pp113-114), eucalyptus (p 115), sunflower (p 118), canola (p 118), turfgrass (p121), sugarbeet (p 122), coffee (p 122) and dioscorea (p 122), (Christou, In: Particle Bombardment for Genetic Engineering of Plants, Biotechnology Intelligence Unit. Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Particularly, any of the transcription factors or fragments thereof may be overexpressed in a transformed cell or transgenic plant. Such overexpression may be the result of transient or stable transfer of the exogenous genetic material.

Exogenous genetic material may be transferred into a plant cell and the plant cell by the use of a DNA vector or construct designed for such a purpose. Design of such a vector is generally within the skill of the art (See, Plant Molecular Biology: A Laboratory Manual, Clark (ed.), Springier, N.Y. (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., Proc. Natl. Acad. Sci. (U.S.A.) 84:5745-5749 (1987), the entirety of which is herein incorporated by reference), the octopine synthase (OCS) promoter (which are carried on tumor-inducing plasmids of Agrobacterium tumefaciens), the caulimovirus promoters such as the cauliflower mosaic virus (CaMV) 19S promoter (Lawton et al., Plant Mol. Biol. 9:315-324 (1987), the entirety of which is herein incorporated by reference) and the CAMV 35S promoter (Odell et al., Nature 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., Proc. Natl. Acad. Sci. (U.S.A.) 84:6624-6628 (1987), the entirety of which is herein incorporated by reference), the sucrose synthase promoter (Yang et al., Proc. Natl. Acad. Sci. (U.S.A.) 87:4144-4148 (1990), the entirety of which is herein incorporated by reference), the R gene complex promoter (Chandler et al., The Plant Cell 1:1175-1183 (1989), the entirety of which is herein incorporated by reference) and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of the transcription factor to cause the desired phenotype. In addition to promoters that are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., Proc. Natl. Acad. Sci. (U.S.A.) 87:3459-3463 (1990), herein incorporated by reference in its entirety), the chloroplast fructose-1,6-biphosphatase (FBPase) promoter from wheat (Lloyd et al., Mol. Gen. Genet. 225:209-216 (1991), herein incorporated by reference in its entirety), the nuclear photosynthetic ST-LS1 promoter from potato (Stockhaus et al., EMBO J. 8:2445-2451 (1989), herein incorporated by reference in its entirety), the serine/threonine kinase (PAL) promoter and the glucoamylase (CHS) promoter from Arabidopsis thaliana. Also reported to be active in photosynthetically active tissues are the ribulose-1,5-bisphosphate carboxylase (RbcS) promoter from eastern larch (Larix laricina), the promoter for the cab gene, cab6, from pine (Yamamoto et al., Plant Cell Physiol. 35:773-778 (1994), herein incorporated by reference in its entirety), the promoter for the Cab-1 gene from wheat (Fejes et al., Plant Mol. Biol. 15:921-932 (1990), herein incorporated by reference in its entirety), the promoter for the CAB-1 gene from spinach (Lubberstedt et al., Plant Physiol. 104:997-1006 (1994), herein incorporated by reference in its entirety), the promoter for the cab1R gene from rice (Luan et al., Plant Cell. 4:971-981 (1992), the entirety of which is herein incorporated by reference), the pyruvate, orthophosphate dikinase (PPDK) promoter from maize (Matsuoka et al., Proc. Natl. Acad. Sci. (U.S.A.) 90: 9586-9590 (1993), herein incorporated by reference in its entirety), the promoter for the tobacco Lhcb1*2 gene (Cerdan et al., Plant Mol. Biol. 33:245-255 (1997), herein incorporated by reference in its entirety), the Arabidopsis thaliana SUC2 sucrose-H+ symporter promoter (Truernit et al., Planta. 196:564-570 (1995), herein incorporated by reference in its entirety) and the promoter for the thylakoid membrane proteins from spinach (psaD, psaF, psaE, PC, FNR, atpC, atpD, cab, rbcS). Other promoters for the chlorophyll a/b-binding proteins may also be utilized in the present invention, such as the promoters for LhcB gene and PsbP gene from white mustard (Sinapis alba; Kretsch et al., *Plant Mol. Biol.* 28:219-229 (1995), the entirety of which is herein incorporated by reference).

For the purpose of expression in sink tissues of the plant, such as the tuber of the potato plant, the fruit of tomato, or the seed of maize, wheat, rice and barley, it is preferred that the promoters utilized in the present invention have relatively high expression in these specific tissues. A number of promoters for genes with tuber-specific or-enhanced expression are known, including the class I patatin promoter (Bevan et al., *EMBO J.* 8:1899-1906 (1986); Jefferson et al., *Plant Mol. Biol.* 14:995-1006 (1990), both of which are herein incorporated by reference in its entirety), the promoter for the potato tuber ADPGPP genes, both the large and small subunits, the sucrose synthase promoter (Salanoubat and Belliard, *Gene.* 60:47-56 (1987), Salanoubat and Belliard, *Gene.* 84:181-185 (1989), both of which are incorporated by reference in their entirety), the promoter for the major tuber proteins including the 22 kd protein complexes and proteinase inhibitors (Hannapel, *Plant Physiol.* 101:703-704 (1993), herein incorporated by reference in its entirety), the promoter for the granule bound starch synthase gene (GBSS) (Visser et al., *Plant Mol. Biol.* 17:691-699 (1991), herein incorporated by reference in its entirety) and other class I and II patatins promoters (Koster-Topfer et al., *Mol Gen Genet.* 219:390-396 (1989); Mignery et al., *Gene.* 62:27-44 (1988), both of which are herein incorporated by reference in their entirety).

Other promoters can also be used to express a transcription factor or fragment thereof in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zeingenes have been isolated (Pedersen et al., *Cell* 29:1015-1026 (1982), herein incorporated by reference in its entirety) and the promoters from these clones, including the 15 kD, 16 kD, 19 kD, 22 kD, 27 kD and γ genes, could also be used. Other promoters known to function, for example, in maize include the promoters for the following genes: waxy, Brittle, Shrunken 2, Branching enzymes I and II, starch synthases, debranching enzymes, oleosins, glutelins and sucrose synthases. A particularly preferred promoter for maize endosperm expression is the promoter for the glutelin gene from rice, more particularly the Osgt-1 promoter (Zheng et al., *Mol. Cell Biol.* 13:5829-5842 (1993), herein incorporated by reference in its entirety). Examples of promoters suitable for expression in wheat include those promoters for the ADPglucose pyrosynthase (ADPGPP) subunits, the granule bound and other starch synthase, the branching and debranching enzymes, the embryogenesis-abundant proteins, the gliadins and the glutenins. Examples of such promoters in rice include those promoters for the ADPGPP subunits, the granule bound and other starch synthase, the branching enzymes, the debranching enzymes, sucrose synthases and the glutelins. A particularly preferred promoter is the promoter for rice glutelin, Osgt-1. Examples of such promoters for barley include those for the ADPGPP subunits, the granule bound and other starch synthase, the branching enzymes, the debranching enzymes, sucrose synthases, the hordeins, the embryo globulins and the aleurone specific proteins.

Root specific promoters may also be used. An example of such a promoter is the promoter for the acid chitinase gene (Samac et al., *Plant Mol. Biol.* 25:587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci. (U.S.A.)* 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435; and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include with the coding region of interest a nucleic acid sequence that acts, in whole or in part, to terminate transcription of that region. For example, such sequences have been isolated including the Tr7 3' sequence and the NOS 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., Plant Physiol. 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405 (1987), the entirety of which is herein incorporated by reference; Jefferson et al., *EMBO J.* 6:3901-3907 (1987), the entirety of which is herein incorporated by reference); an R-locus gene, which encodes a product that regulates the production of anthocyanin pigments (red color) in plant tissues (Dellaporta et al., Stadler Symposium 11:263-282 (1988), the entirety of which is herein incorporated by reference); a β-lactamase gene (Sutcliffe et al., *Proc. Natl. Acad. Sci.* (*U.S.A.*) 75:3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234:856-859 (1986), the entirety of which is herein incorporated by reference); a xy1E gene (Zukowsky et al., *Proc. Natl. Acad. Sci.* (*U.S.A.*) 80:1101-1105 (1983), the entirety of which is herein incorporated by reference) which encodes a catechol diozygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc (Potrykus, *Ann. Rev. Plant Physiol. Plant Mol. Biol.* 42:205-225 (1991), the entirety of which is herein incorporated by reference; Vasil, *Plant Mol. Biol.* 25:925-937 (1994), the entirety of which is herein incorporated by reference). For example, electroporation has been used to transform maize protoplasts (Fromm et al., *Nature* 312:791-793 (1986), the entirety of which is herein incorporated by reference).

Other vector systems suitable for introducing transforming DNA into a host plant cell include but are not limited to binary artificial chromosome (BIBAC) vectors (Hamilton et al., *Gene* 200:107-116 (1997), the entirety of which is herein incorporated by reference); and transfection with RNA viral vectors (Della-Cioppa et al., *Ann. N.Y. Acad. Sci.* (1996), 792 (Engineering Plants for Commercial Products and Applications), 57-61, the entirety of which is herein incorporated by reference). Additional vector systems also include plant selectable YAC vectors such as those described in Mullen et al., *Molecular Breeding* 4:449-457 (1988), the entireity of which is herein incorporated by reference).

Technology for introduction of DNA into cells is well known to those of skill in the art. Four general methods for delivering a gene into cells have been described: (1) chemical methods (Graham and van der Eb, *Virology* 54:536-539 (1973), the entirety of which is herein incorporated by reference); (2) physical methods such as microinjection (Capecchi, *Cell* 22:479-488 (1980), the entirety of which is herein incorporated by reference), electroporation (Wong and Neumann, *Biochem. Biophys. Res. Commun.* 107:584-587 (1982); Fromm et al., *Proc. Natl. Acad. Sci.* (*U.S.A.*) 82:5824-5828 (1985); U.S. Pat. No. 5,384,253, all of which are herein incorporated in their entirety); and the gene gun (Johnston and Tang, *Methods Cell Biol.* 43:353-365 (1994), the entirety of which is herein incorporated by reference); (3) viral vectors (Clapp, *Clin. Perinatol.* 20:155-168 (1993); Lu et al., *J. Exp. Med.* 178:2089-2096 (1993); Eglitis and Anderson, *Biotechniques* 6:608-614 (1988), all of which are herein incorporated in their entirety); and (4) receptor-mediated mechanisms (Curiel et al., *Hum. Gen. Ther.* 3:147-154 (1992), Wagner et al., *Proc. Natl. Acad. Sci.* (*USA*) 89:6099-6103 (1992), both of which are incorporated by reference in their entirety).

Acceleration methods that may be used include, for example, microprojectile bombardment and the like. One example of a method for delivering transforming nucleic acid molecules to plant cells is microprojectile bombardment. This method has been reviewed by Yang and Christou (eds.), *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum and the like.

A particular advantage of microprojectile bombardment, in addition to it being an effective means of reproducibly transforming monocots, is that neither the isolation of protoplasts (Cristou et al., *Plant Physiol.* 87:671-674 (1988), the entirety of which is herein incorporated by reference) nor the susceptibility of *Agrobacterium* infection are required. An illustrative embodiment of a method for delivering DNA into maize cells by acceleration is a biolistics α-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2:603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun is available from Bio-Rad Laboratories (Bio-Rad, Hercules, Calif.)(Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment and also the nature of the transforming DNA, such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (*U.S.A.*) 87:8526-8530 (1990); Svab and Maliga, *Proc. Natl. Acad. Sci.* (*U.S.A.*) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described by Fraley et al., *Bio/Technology* 3:629-635 (1985) and Rogers et al., *Methods Enzymol.* 153:253-277 (1987), both of which are herein incorporated by reference in their entirety. Further, the integration of the Ti-DNA is a relatively precise process resulting in few rearrangements. The region of DNA to be transferred is defined by the border sequences and intervening DNA is usually inserted into the plant genome as described (Spielmann et al., *Mol. Gen. Genet.* 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., In: *Plant DNA Infectious Agents*, Hohn and Schell (eds.), Springer-Verlag, N.Y., pp. 179-203 (1985), the entirety of which is herein incorporated by reference. Moreover, technological advances in vectors for *Agrobacterium*-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Methods Enzymol.* 153:253-277 (1987)). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and outcrossing with a non-transgenic plant are also contemplated, as is vegetative propagation.

Transformation of plant protoplasts can be achieved using methods based on calcium phosphate precipitation, polyethylene glycol treatment, electroporation and combinations of these treatments (See, for example, Potrykus et al., *Mol. Gen. Genet.* 205:193-200 (1986); Lorz et al., *Mol. Gen. Genet.* 199:178 (1985); Fromm et al., *Nature* 319:791 (1986); Uchimiya et al., *Mol. Gen. Genet.* 204:204 (1986); Marcotte et al., *Nature* 335:454-457 (1988), all of which are herein incorporated by reference in their entirety).

Application of these systems to different plant strains depends upon the ability to regenerate that particular plant strain from protoplasts. Illustrative methods for the regeneration of cereals from protoplasts are described (Fujimura et al., *Plant Tissue Culture Letters* 2:74 (1985); Toriyama et al., *Theor. Appl. Genet.* 205:34 (1986); Yamada et al., *Plant Cell Rep.* 4:85 (1986); Abdullah et al., *Biotechnolog* 4:1087 (1986), all of which are herein incorporated by reference in their entirety).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology* 6:397 (1988), the entirety of which is herein incorporated by reference). In addition, "particle gun" or high-velocity microprojectile technology can be utilized (Vasil et al., *Bio/Technology* 10:667 (1992), the entirety of which is herein incorporated by reference).

Using the latter technology, DNA is carried through the cell wall and into the cytoplasm on the surface of small metal particles as described (Klein et al., *Nature* 328:70 (1987); Klein et al., *Proc. Natl. Acad. Sci. (U.S.A.)* 85:8502-8505 (1988); McCabe et al., *Bio/Technology* 6:923 (1988), all of which are herein incorporated by reference in their entirety). The metal particles penetrate through several layers of cells and thus allow the transformation of cells within tissue explants.

Other methods of cell transformation can also be used and include but are not limited to introduction of DNA into plants by direct DNA transfer into pollen (Zhou et al., *Methods Enzymol.* 101:433 (1983); Hess et al., *Intern Rev. Cytol.* 107:367 (1987); Luo et al., *Plant Mol Biol. Reporter* 6:165 (1988), all of which are herein incorporated by reference in their entirety), by direct injection of DNA into reproductive organs of a plant (Pena et al., *Nature* 325:274 (1987), the entirety of which is herein incorporated by reference), or by direct injection of DNA into the cells of immature embryos followed by the rehydration of desiccated embryos (Neuhaus et al., *Theor. Appl. Genet.* 75:30 (1987), the entirety of which is herein incorporated by reference).

The regeneration, development and cultivation of plants from single plant protoplast transformants or from various transformed explants is well known in the art (Weissbach and Weissbach, In: *Methods for Plant Molecular Biology*, Academic Press, San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens* and obtaining transgenic plants have been published for cotton (U.S. Pat. Nos. 5,004,863; 5,159,135; 5,518,908, all of which are herein incorporated by reference in their entirety); soybean (U.S. Pat. Nos. 5,569,834; 5,416,011; McCabe et. al., *Biotechnology* 6:923 (1988); Christou et al., *Plant Physiol.* 87:671-674 (1988); all of which are herein incorporated by reference in their entirety); *Brassica* (U.S. Pat. No. 5,463,174, the entirety of which is herein incorporated by reference); peanut (Cheng et al., *Plant Cell Rep.* 15:653-657 (1996), McKently et al., *Plant Cell Rep.* 14:699-703 (1995), all of which are herein incorporated by reference in their entirety); papaya; and pea (Grant et al., *Plant Cell Rep.* 15:254-258 (1995), the entirety of which is herein incorporated by reference).

Transformation of monocotyledons using electroporation, particle bombardment and *Agrobacterium* have also been reported. Transformation and plant regeneration have been achieved in asparagus (Bytebier et al., *Proc. Natl. Acad. Sci. (USA)* 84:5354 (1987), the entirety of which is herein incorporated by reference); barley (Wan and Lemaux, *Plant Physiol* 104:37 (1994), the entirety of which is herein incorporated by reference); maize (Rhodes et al., *Science* 240:204 (1988); Gordon-Kamm et al., *Plant Cell* 2:603-618 (1990); Fromm et al., *Bio/Technology* 8:833 (1990); Koziel et al., *Bio/Technology* 11:194 (1993); Armstrong et al., *Crop Science* 35:550-557 (1995); all of which are herein incorporated by reference in their entirety); oat (Somers et al., *Bio/Technology* 10:1589 (1992), the entirety of which is herein incorporated by reference); orchard grass (Horn et al., *Plant Cell Rep.* 7:469 (1988), the entirety of which is herein incorporated by reference); rice (Toriyama et al., *Theor Appl. Genet.* 205:34 (1986); Part et al., *Plant Mol. Biol.* 32:1135-1148 (1996); Abedinia et al., *Aust. J. Plant Physiol.* 24:133-141 (1997); Zhang and Wu, *Theor. Appl. Genet.* 76:835 (1988); Zhang et al., *Plant Cell Rep.* 7:379 (1988); Battraw and Hall, *Plant Sci.* 86:191-202 (1992); Christou et al., *Bio/Technology* 9:957 (1991), all of which are herein incorporated by reference in their entirety); rye (De la Pena et al., *Nature* 325:274 (1987), the entirety of which is herein incorporated by reference); sugarcane (Bower and Birch, *Plant J.* 2:409 (1992), the entirety of which is herein incorporated by reference); tall fescue (Wang et al., *Bio/Technology* 10:691 (1992), the entirety of which is herein incorporated by reference) and wheat (Vasil et al., *Bio/Technology* 10:667 (1992), the entirety of which is herein incorporated by reference; U.S. Pat. No. 5,631,152, the entirety of which is herein incorporated by reference.)

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988), the entirety of which is herein incorporated by reference; Marcotte et al., *Plant Cell* 1:523-532 (1989), the entirety of which is herein incorporated by reference; McCarty et al., *Cell* 66:895-905 (1991), the entirety of which is herein incorporated by reference; Hattori et al., *Genes Dev.* 6:609-618 (1992), the entirety of which is herein incorporated by reference; Goff et al., *EMBO J.* 9:2517-2522 (1990), the entirety of which is herein incorporated by reference). Transient expression systems may be used to functionally dissect gene constructs (see generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters, enhancers etc. Further, any of the nucleic acid molecules of the present invention may be introduced into a plant cell in a manner that allows for overexpression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2:279-289 (1990), the entirety of which is herein incorporated by reference; van der Krol et al., *Plant Cell* 2:291-299 (1990), the entirety of which is herein incorporated by reference). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244:325-330 (1994), the entirety of which is herein incorporated by reference). Genes, even though different, linked to homologous promoters may result in the cosuppression of the linked genes (Vaucheret, *C.R. Acad. Sci. III* 316:1471-1483 (1993), the entirety of which is herein incorporated by reference).

This technique has, for example, been applied to generate white flowers from red *petunia* and tomatoes that do not ripen on the vine. Up to 50% of *petunia* transformants that contained a sense copy of the glucoamylase (CHS) gene produced white flowers or floral sectors; this was as a result of the post-transcriptional loss of mRNA encoding CHS (Flavell, *Proc. Natl. Acad. Sci. (U.S.A.)* 91:3490-3496 (1994), the entirety of which is herein incorporated by reference); van Blokland et al., *Plant J.* 6:861-877 (1994), the entirety of which is herein incorporated by reference). Cosuppression may require the coordinate transcription of the transgene and the endogenous gene and can be reset by a developmental control mechanism (Jorgensen, *Trends Biotechnol.* 8:340-344 (1990), the entirety of which is herein incorporated by reference; Meins and Kunz, In: *Gene Inactivation and Homologous Recombination in Plants*, Paszkowski (ed.), pp. 335-348, Kluwer Academic, Netherlands (1994), the entirety of which is herein incorporated by reference).

It is understood that one or more of the nucleic acids of the present invention may be introduced into a plant cell and transcribed using an appropriate promoter with such transcription resulting in the cosuppression of an endogenous transcription factor.

Antisense approaches are a way of preventing or reducing gene function by targeting the genetic material (Mol et al., *FEBS Lett.* 268:427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., In: *Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55:569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25:155-184 (1990), the entirety of which is herein incorporated by reference). An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

It is understood that the activity of a transcription factor in a plant cell may be reduced or depressed by growing a transformed plant cell containing a nucleic acid molecule whose non-transcribed strand encodes a transcription factor or fragment thereof.

Antibodies have been expressed in plants (Hiatt et al., *Nature* 342:76-78 (1989), the entirety of which is herein incorporated by reference; Conrad and Fielder, *Plant Mol. Biol.* 26:1023-1030 (1994), the entirety of which is herein incorporated by reference). Cytoplamsic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489-4496 (1997), the entirety of which is herein incorporated by reference; Marion-Poll, *Trends in Plant Science* 2:447-448 (1997), the entirety of which is herein incorporated by reference). For example, expressed anti-abscisic antibodies have been reported to result in a general perturbation of seed development (Philips et al., *EMBO J.* 16: 4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997), the entirety of which is herein incorporated by reference; Baca et al., *Ann. Rev. Biophys. Biomol. Struct.* 26:461-493 (1997), the entirety of which is herein incorporated by reference). The catalytic abilities of abzymes may be enhanced by site directed mutagenesis. Examples of abzymes are, for example, set forth in U.S. Pat. Nos: 5,658,753; 5,632,990; 5,631,137; 5,602,015; 5,559,538; 5,576,174; 5,500,358; 5,318,897; 5,298,409; 5,258,289 and 5,194,585, all of which are herein incorporated in their entirety.

It is understood that any of the antibodies of the present invention may be expressed in plants and that such expression can result in a physiological effect. It is also understood that any of the expressed antibodies may be catalytic.

(b) Fungal Constructs and Fungal Transformants

The present invention also relates to a fungal recombinant vector comprising exogenous genetic material. The present invention also relates to a fungal cell comprising a fungal recombinant vector. The present invention also relates to methods for obtaining a recombinant fungal host cell comprising introducing into a fungal host cell exogenous genetic material.

Exogenous genetic material may be transferred into a fungal cell. In a preferred embodiment the exogenous genetic material includes a nucleic acid molecule of the present invention having a sequence selected from the group consisting of SEQ ID NO: 1 through SEQ ID NO: 3853 or complements thereof or fragments of either or other nucleic acid molecule of the present invention. The fungal recombinant vector may be any vector which can be conveniently subjected to recombinant DNA procedures. The choice of a vector will typically depend on the compatibility of the vector with the fungal host cell into which the vector is to be introduced. The vector may be a linear or a closed circular plasmid. The vector system may be a single vector or plasmid or two or more vectors or plasmids which together contain the total DNA to be introduced into the genome of the fungal host.

The fungal vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the fungal cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the fungal host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the fungal host cell and, furthermore, may be non-encoding or encoding sequences.

For autonomous replication, the vector may further comprise an origin of replication enabling the vector to replicate autonomously in the host cell in question. Examples of origin of replications for use in a yeast host cell are the 2 micron origin of replication and the combination of CEN3 and ARS 1. Any origin of replication may be used which is compatible with the fungal host cell of choice.

The fungal vectors of the present invention preferably contain one or more selectable markers which permit easy selection of transformed cells. A selectable marker is a gene the product of which provides, for example biocide or viral resistance, resistance to heavy metals, prototrophy to auxotrophs and the like. The selectable marker may be selected from the group including, but not limited to, amdS (acetamidase), argB (ornithine carbamoyltransferase), bar (phosphinothricin acetyltransferase), hygB (hygromycin phosphotransferase), niaD (nitrate reductase), pyrG (orotidine-5'-phosphate decarboxylase) and sC (sulfate adenyltransferase) and trpC (anthranilate synthase). Preferred for use in an *Aspergillus* cell are the amdS and pyrG markers of *Aspergillus nidulans* or *Aspergillus oryzae* and the bar marker of *Streptomyces hygroscopicus*. Furthermore, selection may be accomplished by co-transformation, e.g., as described in WO 91/17243, the entirety of which is herein incorporated by reference. A nucleic acid sequence of the present invention may be operably linked to a suitable promoter sequence. The promoter sequence is a nucleic acid sequence which is recognized by the fungal host cell for expression of the nucleic acid sequence. The promoter sequence contains transcription and translation control sequences which mediate the expression of the protein or fragment thereof.

A promoter may be any nucleic acid sequence which shows transcriptional activity in the fungal host cell of choice and may be obtained from genes encoding polypeptides either homologous or heterologous to the host cell. Examples of suitable promoters for directing the transcription of a nucleic acid construct of the invention in a filamentous fungal host are promoters obtained from the genes encoding *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase and hybrids thereof. In a yeast host, a useful promoter is the *Saccharomyces cerevisiae* enolase (eno-1) promoter. Particularly preferred promoters are the TAKA amylase, NA2-tpi (a hybrid of the promoters from the genes encoding *Aspergillus niger* neutral alpha-amylase and *Aspergillus oryzae* triose phosphate isomerase) and glaA promoters.

A protein or fragment thereof encoding nucleic acid molecule of the present invention may also be operably linked to a terminator sequence at its 3' terminus. The terminator sequence may be native to the nucleic acid sequence encoding the protein or fragment thereof or may be obtained from foreign sources. Any terminator which is functional in the fungal host cell of choice may be used in the present invention, but particularly preferred terminators are obtained from the genes encoding *Aspergillus oryzae* TAKA amylase, *Aspergillus niger* glucoamylase, *Aspergillus nidulans* anthranilate synthase, *Aspergillus niger* alpha-glucosidase and *Saccharomyces cerevisiae* enolase.

A protein or fragment thereof encoding nucleic acid molecule of the present invention may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the fungal host cell of choice may be used in the present invention, but particularly preferred leaders are obtained from the genes encoding *Aspergillus oryzae* TAKA amylase and *Aspergillus oryzae* triose phosphate isomerase.

A polyadenylation sequence may also be operably linked to the 3' terminus of the nucleic acid sequence of the present invention. The polyadenylation sequence is a sequence which when transcribed is recognized by the fungal host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention, but particularly preferred polyadenylation sequences are obtained from the genes encoding *Aspergillus oryzae* TAKA amylase, *Aspergillus niger* glucoamylase, *Aspergillus nidulans* anthranilate synthase and *Aspergillus niger* alpha-glucosidase.

To avoid the necessity of disrupting the cell to obtain the protein or fragment thereof and to minimize the amount of possible degradation of the expressed protein or fragment thereof within the cell, it is preferred that expression of the protein or fragment thereof gives rise to a product secreted outside the cell. To this end, a protein or fragment thereof of the present invention may be linked to a signal peptide linked to the amino terminus of the protein or fragment thereof. A signal peptide is an amino acid sequence which permits the secretion of the protein or fragment thereof from the fungal host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof. Alternatively, the 5' end of the coding sequence may contain a signal peptide coding region which is foreign to that portion of the coding sequence which encodes the secreted protein or fragment thereof. The foreign signal peptide may be required where the coding sequence does not normally contain a signal peptide coding region. Alternatively, the foreign signal peptide may simply replace the natural signal peptide to obtain enhanced secretion of the desired protein or fragment thereof. The foreign signal peptide coding region may be obtained from a glucoamylase or an amylase gene from an *Aspergillus* species, a lipase or proteinase gene from *Rhizomucor miehei*, the gene for the alpha-factor from *Saccharomyces cerevisiae*, or the calf preprochymosin gene. An effective signal peptide for fungal host cells is the *Aspergillus oryzae* TAKA amylase signal, *Aspergillus niger* neutral amylase signal, the *Rhizomucor miehei* aspartic proteinase signal, the *Humicola lanuginosus* cellulase signal, or the *Rhizomucor miehei* lipase signal. However, any signal peptide capable of permitting secretion of the protein or fragment thereof in a fungal host of choice may be used in the present invention.

A protein or fragment thereof encoding nucleic acid molecule of the present invention may also be linked to a propeptide coding region. A propeptide is an amino acid sequence found at the amino terminus of aproprotein or proenzyme. Cleavage of the propeptide from the proprotein yields a mature biochemically active protein. The resulting polypeptide is known as a propolypeptide or proenzyme (or a zymogen in some cases). Propolypeptides are generally inactive and can be converted to mature active polypeptides by catalytic or autocatalytic cleavage of the propeptide from the propolypeptide or proenzyme. The propeptide coding region may be native to the protein or fragment thereof or may be obtained from foreign sources. The foreign propeptide coding region may be obtained from the *Saccharomyces cerevisiae* alpha-factor gene or *Myceliophthora thermophila* laccase gene (WO 95/33836, the entirety of which is herein incorporated by reference).

The procedures used to ligate the elements described above to construct the recombinant expression vector of the present invention are well known to one skilled in the art (see, for example, Sambrook et al., *Molecular Cloning, A Laboratory Manual,* 2nd ed., Cold Spring Harbor, N.Y., (1989)).

The present invention also relates to recombinant fungal host cells produced by the methods of the present invention which are advantageously used with the recombinant vector of the present invention. The cell is preferably transformed with a vector comprising a nucleic acid sequence of the invention followed by integration of the vector into the host chromosome. The choice of fungal host cells will to a large extent depend upon the gene encoding the protein or fragment thereof and its source. The fungal host cell may, for example, be a yeast cell or a filamentous fungal cell.

"Yeast" as used herein includes *Ascosporogenous* yeast (*Endomycetales*), *Basidiosporogenous* yeast and yeast belonging to the Fungi Imperfecti (*Blastomycetes*). The *Ascosporogenous* yeasts are divided into the families Spermophthoraceae and Saccharomycetaceae. The latter is comprised of four subfamilies, Schizosaccharomycoideae (for example, genus *Schizosaccharomyces*), Nadsonioideae, Lipomycoideae and Saccharomycoideae (for example, genera *Pichia, Kluyveromyces* and *Saccharomyces*). The *Basidiosporogenous* yeasts include the genera *Leucosporidim, Rhodosporidium, Sporidiobolus, Filobasidium* and *Filobasidiella*. Yeast belonging to the Fungi Imperfecti are divided into two families, Sporobolomycetaceae (for example, genera *Sorobolomyces* and *Bullera*) and Cryptococcaceae (for example, genus *Candida*). Since the classification of yeast may change in the future, for the purposes of this invention, yeast shall be defined as described in Biology and Activities of Yeast (Skinner et al., *Soc. App. Bacteriol. Symposium Series* No. 9, (1980), the entirety of which is herein incorporated by reference). The biology of yeast and manipulation of yeast genetics are well known in the art (see, for example, *Biochemistry and Genetics of Yeast*, Bacil et al. (ed.), 2nd edition, 1987; *The Yeasts*, Rose and Harrison (eds.), 2nd ed., (1987); and *The Molecular Biology of the Yeast Saccharomyces*, Strathern et al. (eds.), (1981), all of which are herein incorporated by reference in their entirety). "Fungi" as used herein includes the phyla Ascomycota, Basidiomycota, Chytridiomycota and Zygomycota (as defined by Hawksworth et al., In: Ainsworth and Bisby's *Dictionary of The Fungi,* 8th edition, 1995, CAB International, University Press, Cambridge, UK; the entirety of which is herein incorporated by reference) as well as the Oomycota (as cited in Hawksworth et al., In: Ainsworth and Bisby's *Dictionary of The Fungi,* 8th edition, 1995, CAB International, University Press, Cambridge, UK) and all mitosporic fungi (Hawksworth et al., In: Ainsworth and Bisby's *Dictionary of The Fungi,* 8th edition, 1995, CAB International, University Press, Cambridge, UK). Representative groups of Ascomycota include, for example, *Neurospora,* Eupenicillium (=*Penicillium*), Emericella (=*Aspergillus*), Eurotiun (=*Aspergillus*) and the true yeasts listed above. Examples of Basidiomycota include mushrooms, rusts and smuts. Representative groups of Chytridiomycota include, for example, Allomyces, Blastocladiella, Coelomomyces and aquatic fungi. Representative groups of Oomycota include, for example, Saprolegniomycetous aquatic fungi (water molds) such as Achlya. Examples of mitosporic fungi include *Aspergillus, Penicillium, Candida* and *Alternaria*. Representative groups of Zygomycota include, for example, *Rhizopus* and *Mucor*.

"Filamentous fungi" include all filamentous forms of the subdivision Eumycota and Oomycota (as defined by Hawksworth et al., In: Ainsworth and Bisby's *Dictionary of The Fungi,* 8th edition, 1995, CAB International, University Press, Cambridge, UK). The filamentous fungi are characterized by a vegetative mycelium composed of chitin, cellulose, glucan, chitosan, mannan and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

In one embodiment, the fungal host cell is a yeast cell. In a preferred embodiment, the yeast host cell is a cell of the species of *Candida, Kluyveromyces, Saccharomyces, Schizosaccharomyces, Pichia* and *Yarrowia*. In a preferred embodiment, the yeast host cell is a *Saccharomyces cerevisiae* cell, a *Saccharomyces carlsbergensis, Saccharomyces diastaticus* cell, a *Saccharomyces douglasii* cell, a *Saccharomyces kluyveri* cell, a *Saccharomyces norbensis* cell, or a *Saccharomyces oviformis* cell. In another preferred embodiment, the yeast host cell is a *Kluyveromyces lactis* cell. In another preferred embodiment, the yeast host cell is a *Yarrowia lipolytica* cell.

In another embodiment, the fungal host cell is a filamentous fungal cell. In a preferred embodiment, the filamentous fungal host cell is a cell of the species of, but not limited to, *Acremonium, Aspergillus, Fusarium, Humicola, Mycelioph-*

*thora, Mucor, Neurospora, Penicillium, Thielavia, Tolypocladium* and *Trichoderma*. In a preferred embodiment, the filamentous fungal host cell is an *Aspergillus* cell. In another preferred embodiment, the filamentous fungal host cell is an *Acremonium* cell. In another preferred embodiment, the filamentous fungal host cell is a *Fusarium* cell. In another preferred embodiment, the filamentous fungal host cell is a *Humicola* cell. In another preferred embodiment, the filamentous fungal host cell is a *Myceliophthora* cell. In another even preferred embodiment, the filamentous fungal host cell is a *Mucor* cell. In another preferred embodiment, the filamentous fungal host cell is a *Neurospora* cell. In another preferred embodiment, the filamentous fungal host cell is a *Penicillium* cell. In another preferred embodiment, the filamentous fungal host cell is a *Thielavia* cell. In another preferred embodiment, the filamentous fungal host cell is a *Tolypocladiun* cell. In another preferred embodiment, the filamentous fungal host cell is a *Trichoderma* cell. In a preferred embodiment, the filamentous fungal host cell is an *Aspergillus oryzae* cell, an *Aspergillus niger* cell, an *Aspergillus foetidus* cell, or an *Aspergillus japonicus* cell. In another preferred embodiment, the filamentous fungal host cell is a *Fusarium oxysporum* cell or a *Fusarium graminearum* cell. In another preferred embodiment, the filamentous fungal host cell is a *Humicola insolens* cell or a *Humicola lanuginosus* cell. In another preferred embodiment, the filamentous fungal host cell is a *Myceliophthora thermophila* cell. In a most preferred embodiment, the filamentous fungal host cell is a *Mucor miehei* cell. In a most preferred embodiment, the filamentous fungal host cell is a *Neurospora crassa* cell. In a most preferred embodiment, the filamentous fungal host cell is a *Penicillium purpurogenum* cell. In another most preferred embodiment, the filamentous fungal host cell is a *Thielavia terrestris* cell. In another most preferred embodiment, the *Trichoderma* cell is a *Trichoderma reesei* cell, a *Trichoderma viride* cell, a *Trichoderma longibrachiatum* cell, a *Trichoderma harzianum* cell, or a *Trichoderma koningii* cell. In a preferred embodiment, the fungal host cell is selected from an *A. nidulans* cell, an *A. niger* cell, an *A. oryzae* cell and an *A. sojae* cell. In a further preferred embodiment, the fungal host cell is an *A. nidulans* cell.

The recombinant fungal host cells of the present invention may further comprise one or more sequences which encode one or more factors that are advantageous in the expression of the protein or fragment thereof, for example, an activator (e.g., a trans-acting factor), a chaperone and a processing protease. The nucleic acids encoding one or more of these factors are preferably not operably linked to the nucleic acid encoding the protein or fragment thereof. An activator is a protein which activates transcription of a nucleic acid sequence encoding a polypeptide (Kudla et al., *EMBO* 9:1355-1364(1990); Jarai and Buxton, *Current Genetics* 26:2238-244(1994); Verdier, *Yeast* 6:271-297(1990), all of which are herein incorporated by reference in their entirety). The nucleic acid sequence encoding an activator may be obtained from the genes encoding *Saccharomyces cerevisiae* heme activator protein 1 (hap 1), *Saccharomyces cerevisiae* galactose metabolizing protein 4 (gal4) and *Aspergillus nidulans* ammonia regulation protein (areA). For further examples, see Verdier, *Yeast* 6:271-297 (1990); MacKenzie et al., *Journal of Gen. Microbiol.* 139:2295-2307 (1993), both of which are herein incorporated by reference in their entirety). A chaperone is a protein which assists another protein in folding properly (Hartl et al., *TIBS* 19:20-25 (1994); Bergeron et al., *TIBS* 19:124-128 (1994); Demolder et al., *J. Biotechnology* 32:179-189 (1994); Craig, *Science* 260:1902-1903(1993); Gething and Sambrook, *Nature* 355:33-45 (1992); Puig and Gilbert, *J Biol. Chem.* 269:7764-7771 (1994); Wang and Tsou, *FASEB Journal* 7:1515-11157 (1993); Robinson et al., *Bio/Technology* 1:381-384 (1994), all of which are herein incorporated by reference in their entirety). The nucleic acid sequence encoding a chaperone may be obtained from the genes encoding *Aspergillus oryzae* protein disulphide isomerase, *Saccharomyces cerevisiae* calnexin, *Saccharomyces cerevisiae* BiP/GRP78 and *Saccharomyces cerevisiae* Hsp70. For further examples, see Gething and Sambrook, *Nature* 355:33-45 (1992); Hartl et al., *TIBS* 19:20-25 (1994). A processing protease is a protease that cleaves a propeptide to generate a mature biochemically active polypeptide (Enderlin and Ogrydziak, *Yeast* 10:67-79 (1994); Fuller et al., *Proc. Natl. Acad. Sci. (U.S.A.)* 86:1434-1438 (1989); Julius et al., *Cell* 37:1075-1089 (1984); Julius et al., *Cell* 32:839-852 (1983), all of which are incorporated by reference in their entirety). The nucleic acid sequence encoding a processing protease may be obtained from the genes encoding *Aspergillus niger* Kex2, *Saccharomyces cerevisiae* dipeptidylaminopeptidase, *Saccharomyces cerevisiae* Kex2 and *Yarrowia lipolytica* dibasic processing endoprotease (xpr6). Any factor that is functional in the fungal host cell of choice may be used in the present invention.

Fungal cells may be transformed by a process involving protoplast formation, transformation of the protoplasts and regeneration of the cell wall in a manner known per se. Suitable procedures for transformation of *Aspergillus* host cells are described in EP 238 023 and Yelton et al., *Proc. Natl. Acad. Sci. (U.S.A.)* 81:1470-1474 (1984), both of which are herein incorporated by reference in their entirety. A suitable method of transforming *Fusarium* species is described by Malardier et al., *Gene* 78:147-156 (1989), the entirety of which is herein incorporated by reference. Yeast may be transformed using the procedures described by Becker and Guarente, In: Abelson and Simon, (eds.), *Guide to Yeast Genetics and Molecular Biology, Methods Enzymol.* Volume 194, pp 182-187, Academic Press, Inc., New York; Ito et al., *J. Bacteriology* 153:163 (1983); Hinnen et al., *Proc. Natl. Acad. Sci. (U.S.A.)* 75:1920 (1978), all of which are herein incorporated by reference in their entirety.

The present invention also relates to methods of producing the protein or fragment thereof comprising culturing the recombinant fungal host cells under conditions conducive for expression of the protein or fragment thereof. The fungal cells of the present invention are cultivated in a nutrient medium suitable for production of the protein or fragment thereof using methods known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the protein or fragment thereof to be expressed and/or isolated. The cultivation takes place in a suitable nutrient medium comprising carbon and nitrogen sources and inorganic salts, using procedures known in the art (see, e.g., Bennett and LaSure (eds.), *More Gene Manipulations in Fungi*, Academic Press, Calif., (1991), the entirety of which is herein incorporated by reference). Suitable media are available from commercial suppliers or may be prepared according to published compositions (e.g., in catalogues of the American Type Culture Collection, Manassas, Va.). If the protein or fragment thereof is secreted into the nutrient medium, a protein or fragment thereof can be recovered directly from the medium. If the protein or fragment thereof is not secreted, it is recovered from cell lysates.

The expressed protein or fragment thereof may be detected using methods known in the art that are specific for the particular protein or fragment. These detection methods may include the use of specific antibodies, formation of an enzyme product, or disappearance of an enzyme substrate. For example, if the protein or fragment thereof has enzymatic activity, an enzyme assay may be used. Alternatively, if polyclonal or monoclonal antibodies specific to the protein or fragment thereof are available, immunoassays may be employed using the antibodies to the protein or fragment thereof. The techniques of enzyme assay and immunoassay are well known to those skilled in the art.

The resulting protein or fragment thereof may be recovered by methods known in the arts. For example, the protein or fragment thereof may be recovered from the nutrient medium by conventional procedures including, but not limited to, centrifugation, filtration, extraction, spray-drying, evaporation, or precipitation. The recovered protein or fragment thereof may then be further purified by a variety of chromatographic procedures, e.g., ion exchange chromatography, gel filtration chromatography, affinity chromatography, or the like.

(c) Mammalian Constructs and Transformed Mammalian Cells

The present invention also relates to methods for obtaining a recombinant mammalian host cell, comprising introducing into a mammalian host cell exogenous genetic material. The present invention also relates to a mammalian cell comprising a mammalian recombinant vector. The present invention also relates to methods for obtaining a recombinant mammalian host cell, comprising introducing into a mammalian cell exogenous genetic material. In a preferred embodiment the exogenous genetic material includes a nucleic acid molecule of the present invention having a sequence selected from the group consisting of SEQ ID NO: 1 through SEQ ID NO: 3853 or complements thereof or fragments of either or other nucleic acid molecule of the present invention.

Mammalian cell lines available as hosts for expression are known in the art and include many immortalized cell lines available from the American Type Culture Collection (ATCC, Manassas, Va.), such as HeLa cells, Chinese hamster ovary (CHO) cells, baby hamster kidney (BHK) cells and a number of other cell lines. Suitable promoters for mammalian cells are also known in the art and include viral promoters such as that from Simian Virus 40 (SV40) (Fiers et al., *Nature* 273: 113 (1978), the entirety of which is herein incorporated by reference), Rous sarcoma virus (RSV), adenovirus (ADV) and bovine papilloma virus (BPV). Mammalian cells may also require terminator sequences and poly-A addition sequences. Enhancer sequences which increase expression may also be included and sequences which promote amplification of the gene may also be desirable (for example methotrexate resistance genes).

Vectors suitable for replication in mammalian cells may include viral replicons, or sequences which insure integration of the appropriate sequences encoding HCV epitopes into the host genome. For example, another vector used to express foreign DNA is vaccinia virus. In this case, for example, a nucleic acid molecule encoding a protein or fragment thereof is inserted into the vaccinia genome. Techniques for the insertion of foreign DNA into the vaccinia virus genome are known in the art and may utilize, for example, homologous recombination. Such heterologous DNA is generally inserted into a gene which is non-essential to the virus, for example, the thymidine kinase gene (tk), which also provides a selectable marker. Plasmid vectors that greatly facilitate the construction of recombinant viruses have been described (see, for example, Mackett et al., *J Virol.* 49:857 (1984); Chakrabarti et al., *Mol. Cell. Biol.* 5:3403 (1985); Moss, In: *Gene Transfer Vectors For Mammalian Cells* (Miller and Calos, eds., Cold Spring Harbor Laboratory, N.Y., p. 10, (1987); all of which are herein incorporated by reference in their entirety). Expression of the HCV polypeptide then occurs in cells or animals which are infected with the live recombinant vaccinia virus.

The sequence to be integrated into the mammalian sequence may be introduced into the primary host by any convenient means, which includes calcium precipitated DNA, spheroplast fusion, transformation, electroporation, biolistics, lipofection, microinjection, or other convenient means. Where an amplifiable gene is being employed, the amplifiable gene may serve as the selection marker for selecting hosts into which the amplifiable gene has been introduced. Alternatively, one may include with the amplifiable gene another marker, such as a drug resistance marker, e.g. neomycin resistance (G418 in mammalian cells), hygromycin in resistance etc., or an auxotrophy marker (HIS3, TRP1, LEU2, URA3, ADE2, LYS2, etc.) for use in yeast cells.

Depending upon the nature of the modification and associated targeting construct, various techniques may be employed for identifying targeted integration. Conveniently, the DNA may be digested with one or more restriction enzymes and the fragments probed with an appropriate DNA fragment which will identify the properly sized restriction fragment associated with integration.

One may use different promoter sequences, enhancer sequences, or other sequence which will allow for enhanced levels of expression in the expression host. Thus, one may combine an enhancer from one source, a promoter region from another source, a 5'-noncoding region upstream from the initiation methionine from the same or different source as the other sequences and the like. One may provide for an intron in the non-coding region with appropriate splice sites or for an alternative 3'-untranslated sequence or polyadenylation site. Depending upon the particular purpose of the modification, any of these sequences may be introduced, as desired.

Where selection is intended, the sequence to be integrated will have with it a marker gene, which allows for selection. The marker gene may conveniently be downstream from the target gene and may include resistance to a cytotoxic agent, e.g. antibiotics, heavy metals, or the like, resistance or susceptibility to HAT, gancyclovir, etc., complementation to an auxotrophic host, particularly by using an auxotrophic yeast as the host for the subject manipulations, or the like. The marker gene may also be on a separate DNA molecule, particularly with primary mammalian cells. Alternatively, one may screen the various transformants, due to the high efficiency of recombination in yeast, by using hybridization analysis, PCR, sequencing, or the like.

For homologous recombination, constructs can be prepared where the amplifiable gene will be flanked, normally on both sides with DNA homologous with the DNA of the target region. Depending upon the nature of the integrating DNA and the purpose of the integration, the homologous DNA will generally be within 100 kb, usually 50 kb, preferably about 25 kb, of the transcribed region of the target gene, more preferably within 2 kb of the target gene. Where modeling of the gene is intended, homology will usually be present proximal to the site of the mutation. The homologous DNA may include the 5'-upstream region outside of the transcriptional regulatory region or comprising any enhancer sequences, transcriptional initiation sequences, adjacent sequences, or the like. The homologous region may include a portion of the coding region, where the coding region may be comprised only of an open reading frame or combination of exons and introns. The homologous region may comprise all or a portion of an intron, where all or a portion of one or more exons may also be present. Alternatively, the homologous region may comprise the 3'-region, so as to comprise all or a portion of the transcriptional termination region, or the region 3' of this region. The homologous regions may extend over all or a portion of the target gene or be outside the target gene comprising all or a portion of the transcriptional regulatory regions and/or the structural gene.

The integrating constructs may be prepared in accordance with conventional ways, where sequences may be synthesized, isolated from natural sources, manipulated, cloned, ligated, subjected to in vitro mutagenesis, primer repair, or the like. At various stages, the joined sequences may be cloned and analyzed by restriction analysis, sequencing, or the like. Usually during the preparation of a construct where various fragments are joined, the fragments, intermediate constructs and constructs will be carried on a cloning vector comprising a replication system functional in a prokaryotic host, e.g., *E. coli* and a marker for selection, e.g., biocide resistance, complementation to an auxotrophic host, etc. Other functional sequences may also be present, such as polylinkers, for ease of introduction and excision of the construct or portions thereof, or the like. A large number of cloning vectors are available such as pBR322, the pUC series, etc. These constructs may then be used for integration into the primary mammalian host.

In the case of the primary mammalian host, a replicating vector may be used. Usually, such vector will have a viral replication system, such as SV40, bovine papilloma virus, adenovirus, or the like. The linear DNA sequence vector may also have a selectable marker for identifying transfected cells. Selectable markers include the neo gene, allowing for selection with G418, the herpes tk gene for selection with HAT medium, the gpt gene with mycophenolic acid, complementation of an auxotrophic host, etc.

The vector may or may not be capable of stable maintenance in the host. Where the vector is capable of stable maintenance, the cells will be screened for homologous integration of the vector into the genome of the host, where various techniques for curing the cells may be employed. Where the vector is not capable of stable maintenance, for example, where a temperature sensitive replication system is employed, one may change the temperature from the permissive temperature to the non-permissive temperature, so that the cells may be cured of the vector. In this case, only those cells having integration of the construct comprising the amplifiable gene and, when present, the selectable marker, will be able to survive selection.

Where a selectable marker is present, one may select for the presence of the targeting construct by means of the selectable marker. Where the selectable marker is not present, one may select for the presence of the construct by the amplifiable gene. For the neo gene or the herpes tk gene, one could employ a medium for growth of the transformants of about 0.1-1 mg/ml of G418 or may use HAT medium, respectively. Where DHFR is the amplifiable gene, the selective medium may include from about 0.01-0.5 µM of methotrexate or be deficient in glycine-hypoxanthine-thymidine and have dialysed serum (GHT media).

The DNA can be introduced into the expression host by a variety of techniques that include calcium phosphate/DNA co-precipitates, microinjection of DNA into the nucleus, electroporation, yeast protoplast fusion with intact cells, transfection, polycations, e.g., polybrene, polyornithine, etc., or the like. The DNA may be single or double stranded DNA, linear or circular. The various techniques for transforming mammalian cells are well known (see Keown et al., *Methods Enzymol.* (1989); Keown et al., *Methods Enzymol.* 185:527-537 (1990); Mansour et al., *Nature* 336:348-352, (1988); all of which are herein incorporated by reference in their entirety).

(d) Insect Constructs and Transformed Insect Cells

The present invention also relates to an insect recombinant vectors comprising exogenous genetic material. The present invention also relates to an insect cell comprising an insect recombinant vector. The present invention also relates to methods for obtaining a recombinant insect host cell, comprising introducing into an insect cell exogenous genetic material. In a preferred embodiment the exogenous genetic material includes a nucleic acid molecule of the present invention having a sequence selected from the group consisting of SEQ ID NO: 1 through SEQ ID NO: 3853 or complements thereof or fragments of either or other nucleic acid molecule of the present invention.

The insect recombinant vector may be any vector which can be conveniently subjected to recombinant DNA procedures and can bring about the expression of the nucleic acid sequence. The choice of a vector will typically depend on the compatibility of the vector with the insect host cell into which the vector is to be introduced. The vector may be a linear or a closed circular plasmid. The vector system may be a single vector or plasmid or two or more vectors or plasmids which together contain the total DNA to be introduced into the genome of the insect host. In addition, the insect vector may be an expression vector. Nucleic acid molecules can be suitably inserted into a replication vector for expression in the insect cell under a suitable promoter for insect cells. Many vectors are available for this purpose and selection of the appropriate vector will depend mainly on the size of the nucleic acid molecule to be inserted into the vector and the particular host cell to be transformed with the vector. Each vector contains various components depending on its function (amplification of DNA or expression of DNA) and the particular host cell with which it is compatible. The vector components for insect cell transformation generally include, but are not limited to, one or more of the following: a signal sequence, origin of replication, one or more marker genes and an inducible promoter.

The insect vector may be an autonomously replicating vector, i. e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the insect cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the insect host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the insect host cell and, furthermore, may be non-encoding or encoding sequences.

Baculovirus expression vectors (BEVs) have become important tools for the expression of foreign genes, both for basic research and for the production of proteins with direct clinical applications in human and veterinary medicine (Doerfler, *Curr. Top. Microbiol. Immunol.* 131:51-68 (1968); Luckow and Summers, *Bio/Technology* 6:47-55 (1988a); Miller, *Annual Review of Microbiol.* 42:177-199 (1988); Summers, *Curr. Comm. Molecular Biology*, Cold Spring Harbor Press, Cold Spring Harbor, N.Y. (1988); all of which are herein incorporated by reference in their entirety). BEVs are recombinant insect viruses in which the coding sequence for a chosen foreign gene has been inserted behind a baculovirus promoter in place of the viral gene, e.g., polyhedrin (Smith and Summers, U.S. Pat. No. 4,745,051, the entirety of which is incorporated herein by reference).

The use of baculovirus vectors relies upon the host cells being derived from Lepidopteran insects such as *Spodoptera frugiperda* or *Trichoplusia ni*. The preferred *Spodoptera frugiperda* cell line is the cell line Sf9. The *Spodoptera frugiperda* Sf9 cell line was obtained from American Type Culture Collection (Manassas, Va.) and is assigned accession number ATCC CRL 1711 (Summers and Smith, *A Manual of Methods for Baculovirus Vectors and Insect Cell Culture Procedures*, Texas Ag. Exper. Station Bulletin No. 1555 (1988), the entirety of which is herein incorporated by reference). Other insect cell systems, such as the silkworm *B. mori* may also be used.

The proteins expressed by the BEVs are, therefore, synthesized, modified and transported in host cells derived from Lepidopteran insects. Most of the genes that have been inserted and produced in the baculovirus expression vector system have been derived from vertebrate species. Other baculovirus genes in addition to the polyhedrin promoter may be employed to advantage in a baculovirus expression system. These include immediate-early (alpha), delayed-early (β), late (γ), or very late (delta), according to the phase of the viral infection during which they are expressed. The expression of these genes occurs sequentially, probably as the result of a "cascade" mechanism of transcriptional regulation. (Guarino and Summers, *J. Virol.* 57:563-571 (1986); Guarino and Summers, *J. Virol.* 61:2091-2099 (1987); Guarino and Summers, *Virol.* 162:444-451 (1988); all of which are herein incorporated by reference in their entirety).

Insect recombinant vectors are useful as intermediates for the infection or transformation of insect cell systems. For example, an insect recombinant vector containing a nucleic acid molecule encoding a baculovirus transcriptional promoter followed downstream by an insect signal DNA sequence is capable of directing the secretion of the desired biologically active protein from the insect cell. The vector may utilize a baculovirus transcriptional promoter region derived from any of the over 500 baculoviruses generally infecting insects, such as for example the Orders Lepidoptera, Diptera, Orthoptera, Coleoptera and Hymenoptera, including for example but not limited to the viral DNAs of *Autographa californica* MNPV, *Bombyx mori* NPV, *Trichoplusia ni* MNPV, *Rachiplusia ou* MNPV or *Galleria mellonella* MNPV, wherein said baculovirus transcriptional promoter is a baculovirus immediate-early gene IEI or IEN promoter; an immediate-early gene in combination with a baculovirus delayed-early gene promoter region selected from the group consisting of 39K and a HindIII-k fragment delayed-early gene; or a baculovirus late gene promoter. The immediate-early or delayed-early promoters can be enhanced with transcriptional enhancer elements. The insect signal DNA sequence may code for a signal peptide of a Lepidopteran adipokinetic hormone precursor or a signal peptide of the *Manduca sexta* adipokinetic hormone precursor (Summers, U.S. Pat. No. 5,155,037; the entirety of which is herein incorporated by reference). Other insect signal DNA sequences include a signal peptide of the *Orthoptera Schistocerca gregaria* locust adipokinetic hormone precurser and the *Drosophila melanogaster* cuticle genes CP1, CP2, CP3 or CP4 or for an insect signal peptide having substantially a similar chemical composition and function (Summers, U.S. Pat. No. 5,155,037).

Insect cells are distinctly different from animal cells. Insects have a unique life cycle and have distinct cellular properties such as the lack of intracellular plasminogen activators in which are present in vertebrate cells. Another difference is the high expression levels of protein products ranging from 1 to greater than 500 mg/liter and the ease at which cDNA can be cloned into cells (Frasier, *In Vitro Cell. Dev. Biol.* 25:225 (1989); Summers and Smith, In: *A Manual of Methods for Baculovirus Vectors and Insect Cell Culture Procedures*, Texas Ag. Exper. Station Bulletin No. 1555 (1988), both of which are incorporated by reference in their entirety).

Recombinant protein expression in insect cells is achieved by viral infection or stable transformation. For viral infection, the desired gene is cloned into baculovirus at the site of the wild-type polyhedron gene (Webb and Summers, *Technique* 2:173 (1990); Bishop and Posse, *Adv. Gene Technol.* 1:55 (1990); both of which are incorporated by reference in their entirety). The polyhedron gene is a component of a protein coat in occlusions which encapsulate virus particles. Deletion or insertion in the polyhedron gene results the failure to form occlusion bodies. Occlusion negative viruses are morphologically different from occlusion positive viruses and enable one skilled in the art to identify and purify recombinant viruses.

The vectors of present invention preferably contain one or more selectable markers which permit easy selection of transformed cells. A selectable marker is a gene the product of which provides, for example biocide or viral resistance, resistance to heavy metals, prototrophy to auxotrophs and the like. Selection may be accomplished by co-transformation, e.g., as described in WO 91/17243, a nucleic acid sequence of the present invention may be operably linked to a suitable promoter sequence. The promoter sequence is a nucleic acid sequence which is recognized by the insect host cell for expression of the nucleic acid sequence. The promoter sequence contains transcription and translation control sequences which mediate the expression of the protein or fragment thereof. The promoter may be any nucleic acid sequence which shows transcriptional activity in the insect host cell of choice and may be obtained from genes encoding polypeptides either homologous or heterologous to the host cell.

For example, a nucleic acid molecule encoding a protein or fragment thereof may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the insect host cell of choice may be used in the present invention.

A polyadenylation sequence may also be operably linked to the 3' terminus of the nucleic acid sequence of the present invention. The polyadenylation sequence is a sequence which when transcribed is recognized by the insect host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention.

To avoid the necessity of disrupting the cell to obtain the protein or fragment thereof and to minimize the amount of possible degradation of the expressed polypeptide within the cell, it is preferred that expression of the polypeptide gene gives rise to a product secreted outside the cell. To this end, the protein or fragment thereof of the present invention may be linked to a signal peptide linked to the amino terminus of the protein or fragment thereof. A signal peptide is an amino acid sequence which permits the secretion of the protein or fragment thereof from the insect host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof.

At present, a mode of achieving secretion of a foreign gene product in insect cells is by way of the foreign gene's native signal peptide. Because the foreign genes are usually from non-insect organisms, their signal sequences may be poorly recognized by insect cells and hence, levels of expression may be suboptimal. However, the efficiency of expression of foreign gene products seems to depend primarily on the characteristics of the foreign protein. On average, nuclear localized or non-structural proteins are most highly expressed, secreted proteins are intermediate and integral membrane proteins are the least expressed. One factor generally affecting the efficiency of the production of foreign gene products in a heterologous host system is the presence of native signal sequences (also termed presequences, targeting signals, or leader sequences) associated with the foreign gene. The signal sequence is generally coded by a DNA sequence immediately following (5' to 3') the translation start site of the desired foreign gene.

The expression dependence on the type of signal sequence associated with a gene product can be represented by the following example: If a foreign gene is inserted at a site downstream from the translational start site of the baculovirus polyhedrin gene so as to produce a fusion protein (containing the N-terminus of the polyhedrin structural gene), the fused gene is highly expressed. But less expression is achieved when a foreign gene is inserted in a baculovirus expression vector immediately following the transcriptional start site and totally replacing the polyhedrin structural gene.

Insertions into the region −50 to −1 significantly alter (reduce) steady state transcription which, in turn, reduces translation of the foreign gene product. Use of the pVL941 vector optimizes transcription of foreign genes to the level of the polyhedrin gene transcription. Even though the transcription of a foreign gene may be optimal, optimal translation may vary because of several factors involving processing: signal peptide recognition, mRNA and ribosome binding, glycosylation, disulfide bond formation, sugar processing, oligomerization, for example.

The properties of the insect signal peptide are expected to be more optimal for the efficiency of the translation process in insect cells than those from vertebrate proteins. This phenomenon can generally be explained by the fact that proteins secreted from cells are synthesized as precursor molecules containing hydrophobic N-terminal signal peptides. The signal peptides direct transport of the select protein to its target membrane and are then cleaved by a peptidase on the membrane, such as the endoplasmic reticulum, when the protein passes through it.

Another exemplary insect signal sequence is the sequence encoding for Drosophila cuticle proteins such as CP1, CP2, CP3 or CP4 (Summers, U.S. Pat. No. 5,278,050; the entirety of which is herein incorporated by reference). Most of a 9 kb region of the Drosophila genome containing genes for the cuticle proteins has been sequenced. Four of the five cuticle genes contains a signal peptide coding sequence interrupted by a short intervening sequence (about 60 base pairs) at a conserved site. Conserved sequences occur in the 5' mRNA untranslated region, in the adjacent 35 base pairs of upstream flanking sequence and at −200 base pairs from the mRNA start position in each of the cuticle genes.

Standard methods of insect cell culture, cotransfection and preparation of plasmids are set forth in Summers and Smith (Summers and Smith, *A Manual of Methods for Baculovirus Vectors and Insect Cell Culture Procedures*, Texas Agricultural Experiment Station Bulletin No. 1555, Texas A&M University (1987)). Procedures for the cultivation of viruses and cells are described in Volkman and Summers, *J. Virol* 19:820-832 (1975) and Volkman et al., *J. Virol* 19:820-832 (1976); both of which are herein incorporated by reference in their entirety.

(e) Bacterial Constructs and Transformed Bacterial Cells

The present invention also relates to a bacterial recombinant vector comprising exogenous genetic material. The present invention also relates to a bacteria cell comprising a bacterial recombinant vector. The present invention also relates to methods for obtaining a recombinant bacteria host cell, comprising introducing into a bacterial host cell exogenous genetic material. In a preferred embodiment the exogenous genetic material includes a nucleic acid molecule of the present invention having a sequence selected from the group consisting of SEQ ID NO: 1 through SEQ ID NO: 3853 or complements thereof or fragments of either or other nucleic acid molecule of the present invention.

The bacterial recombinant vector may be any vector which can be conveniently subjected to recombinant DNA procedures. The choice of a vector will typically depend on the compatibility of the vector with the bacterial host cell into which the vector is to be introduced. The vector may be a linear or a closed circular plasmid. The vector system may be a single vector or plasmid or two or more vectors or plasmids which together contain the total DNA to be introduced into the genome of the bacterial host. In addition, the bacterial vector may be an expression vector. Nucleic acid molecules encoding protein homologues or fragments thereof can, for example, be suitably inserted into a replicable vector for expression in the bacterium under the control of a suitable promoter for bacteria. Many vectors are available for this purpose and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more marker genes and an inducible promoter.

In general, plasmid vectors containing replicon and control sequences that are derived from species compatible with the host cell are used in connection with bacterial hosts. The vector ordinarily carries a replication site, as well as marking sequences that are capable of providing phenotypic selection in transformed cells. For example, E. coli is typically transformed using pBR322, a plasmid derived from an E. coli species (see, e.g., Bolivar et al., Gene 2:95 (1977); the entirety of which is herein incorporated by reference). pBR322 contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes.

Nucleic acid molecules encoding protein or fragments thereof may be expressed not only directly, but also as a fusion with another polypeptide, preferably a signal sequence or other polypeptide having a specific cleavage site at the N-terminus of the mature polypeptide. In general, the signal sequence may be a component of the vector, or it may be a part of the polypeptide DNA that is inserted into the vector. The heterologous signal sequence selected should be one that is recognized and processed (i.e., cleaved by a signal peptidase) by the host cell. For bacterial host cells that do not recognize and process the native polypeptide signal sequence, the signal sequence is substituted by a bacterial signal sequence selected, for example, from the group consisting of the alkaline phosphatase, penicillinase, 1pp, or heat-stable enterotoxin II leaders.

Both expression and cloning vectors contain a nucleic acid sequence that enables the vector to replicate in one or more selected host cells. Generally, in cloning vectors this sequence is one that enables the vector to replicate independently of the host chromosomal DNA and includes origins of replication or autonomously replicating sequences. Such sequences are well known for a variety of bacteria. The origin of replication from the plasmid pBR322 is suitable for most Gram-negative bacteria.

Expression and cloning vectors also generally contain a selection gene, also termed a selectable marker. This gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for *Bacilli*. One example of a selection scheme utilizes a drug to arrest growth of a host cell. Those cells that are successfully transformed with a heterologous protein homologue or fragment thereof produce a protein conferring drug resistance and thus survive the selection regimen.

The expression vector for producing a protein or fragment thereof can also contains an inducible promoter that is recognized by the host bacterial organism and is operably linked to the nucleic acid encoding, for example, the nucleic acid molecule encoding the protein homologue or fragment thereof of interest. Inducible promoters suitable for use with bacterial hosts include the β-lactamase and lactose promoter systems (Chang et al., *Nature* 275:615 (1978); Goeddel et al., *Nature* 281:544 (1979); both of which are herein incorporated by reference in their entirety), the arabinose promoter system (Guzman et al., *J. Bacteriol.* 174:7716-7728 (1992); the entirety of which is herein incorporated by reference), alkaline phosphatase, a tryptophan (trp) promoter system (Goeddel, *Nucleic Acids Res.* 8:4057 (1980); EP 36,776; both of which are herein incorporated by reference in their entirety) and hybrid promoters such as the tac promoter (deBoer et al., *Proc. Natl. Acad. Sci.* (*USA*) 80:21-25 (1983); the entirety of which is herein incorporated by reference). However, other known bacterial inducible promoters are suitable (Siebenlist et al., *Cell* 20:269 (1980); the entirety of which is herein incorporated by reference).

Promoters for use in bacterial systems also generally contain a Shine-Dalgarno (S.D.) sequence operably linked to the DNA encoding the polypeptide of interest. The promoter can be removed from the bacterial source DNA by restriction enzyme digestion and inserted into the vector containing the desired DNA.

Construction of suitable vectors containing one or more of the above-listed components employs standard ligation techniques. Isolated plasmids or DNA fragments are cleaved, tailored and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, encoding an *A. nidulans* protein homologue or fragment thereof homologue, may be ligated into the vector in frame with sequences for the amino-terminal Met and the subsequent 7 residues of β-galactosidase so that a hybrid protein is produced; pIN vectors (Van Heeke and Schuster, *J. Biol. Chem.* 264:5503-5509 (1989), the entirety of which is herein incorporated by reference); and the like. pGEX vectors (Promega, Madison Wis. U.S.A.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin or factor XA protease cleavage sites so that the cloned polypeptide of interest can be released from the GST moiety at will.

Suitable host bacteria for a bacterial vector include archaebacteria and eubacteria, especially eubacteria and most preferably Enterobacteriaceae. Examples of useful bacteria include *Escherichia, Enterobacter, Azotobacter, Erwinia, Bacillus, Pseudomonas, Klebsiella, Proteus, Salmonella, Serratia, Shigella, Rhizobia, Vitreoscilla* and *Paracoccus*. Suitable *E. coli* hosts include *E. coli* W3110 (American Type Culture Collection (ATCC) 27,325, Manassas, Va. U.S.A.), *E. coli* 294 (ATCC 31,446), *E. coli* B and *E. coli* X1776 (ATCC 31,537). These examples are illustrative rather than limiting. Mutant cells of any of the above-mentioned bacteria may also be employed. It is, of course, necessary to select the appropriate bacteria taking into consideration replicability of the replicon in the cells of a bacterium. For example, *E. coli, Serratia,* or *Salmonella* species can be suitably used as the host when well known plasmids such as pBR322, pBR325, pACYC177, or pKN410 are used to supply the replicon. *E coli* strain W3110 is a preferred host or parent host because it is a common host strain for recombinant DNA product fermentations. Preferably, the host cell should secrete minimal amounts of proteolytic enzymes.

Host cells are transfected and preferably transformed with the above-described vectors and cultured in conventional nutrient media modified as appropriate for inducing promoters, selecting transformants, or amplifying the genes encoding the desired sequences.

Numerous methods of transfection are known to the ordinarily skilled artisan, for example, calcium phosphate and electroporation. Depending on the host cell used, transformation is done using standard techniques appropriate to such cells. The calcium treatment employing calcium chloride, as described in section 1.82 of Sambrook et al., *Molecular Cloning: A Laboratory Manual*, New York: Cold Spring Harbor Laboratory Press, (1989), is generally used for bacterial cells that contain substantial cell-wall barriers. Another method for transformation employs polyethylene glycol/DMSO, as described in Chung and Miller (Chung and Miller, *Nucleic Acids Res.* 16:3580 (1988); the entirety of which is herein incorporated by reference). Yet another method is the use of the technique termed electroporation.

Bacterial cells used to produce the polypeptide of interest for purposes of this invention are cultured in suitable media in which the promoters for the nucleic acid encoding the heterologous polypeptide can be artificially induced as described generally, e.g., in Sambrook et al., *Molecular Cloning: A Laboratory Manual*, New York: Cold Spring Harbor Laboratory Press, (1989). Examples of suitable media are given in U.S. Pat. Nos. 5,304,472 and 5,342,763; both of which are incorporated by reference in their entirety.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis Analyzing DNA*, 1, Cold Spring Harbor, N.Y., the entirety of which is herein incorporated by reference).

(f) Computer Readable Media

The nucleotide sequence provided in SEQ ID NO: 1 through SEQ ID NO: 3853 or fragment thereof, or complement thereof, or a nucleotide sequence at least 90% identical, preferably 95%, identical even more preferably 99% or 100% identical to the sequence provided in SEQ ID NO: 1 through SEQ ID NO: 3853 or fragment thereof, or complement thereof, can be "provided" in a variety of mediums to facilitate use. Such a medium can also provide a subset thereof in a form that allows a skilled artisan to examine the sequences.

A preferred subset of nucleotide sequences are those nucleic acid sequences that encode a maize, soybean or *Arabidopsis thaliana* homeobox transcription factor or complement thereof or fragment of either, a nucleic acid molecule that encodes a maize, soybean or *Arabidopsis thaliana* HLH transcription factor or complement thereof or fragment of either, a nucleic acid molecule that encodes a maize, soybean or *Arabidopsis thaliana* leucine zipper transcription factor or complement thereof or fragment of either, a nucleic acid molecule that encodes a maize, soybean or *Arabidopsis thaliana* zinc finger transcription factor or complement thereof or fragment of either and a nucleic acid molecule that encodes a maize, soybean or *Arabidopsis thaliana* other transcription factor or complement thereof or fragment of either.

A further preferred subset of nucleic acid sequences is where the subset of sequences is two proteins or fragments thereof, more preferably three proteins or fragments thereof and even more preferable four transcription factors or fragments thereof, these nucleic acid sequences are selected from the group that comprises a maize, soybean or *Arabidopsis thaliana* homeobox transcription factor or complement thereof or fragment of either, a nucleic acid molecule that encodes a maize, soybean or *Arabidopsis thaliana* HLH transcription factor or complement thereof or fragment of either, a nucleic acid molecule that encodes a maize, soybean or *Arabidopsis thaliana* leucine zipper transcription factor or complement thereof or fragment of either, a nucleic acid molecule that encodes a maize, soybean or *Arabidopsis thaliana* zinc finger transcription factor or complement thereof or fragment of either and a nucleic acid molecule that encodes a maize, soybean or *Arabidopsis thaliana* other transcription factor or complement thereof or fragment of either.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990), the entirety of which is herein incorporated by reference) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification and DNA replication, restriction, modification, recombination and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means and data storage means used to analyze the nucleotide sequence information of the present invention. The minimum hardware means of the computer-based systems of the present invention comprises a central processing unit (CPU), input means, output means and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences the sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention.

Having now generally described the invention, the same will be more readily understood through reference to the following examples which are provided by way of illustration and are not intended to be limiting of the present invention, unless specified.

EXAMPLE 1

The MONN01 cDNA library is a normalized library generated from maize (DK604, Dekalb Genetics, Dekalb, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON001 cDNA library is generated from maize (B73, Illinois Foundation Seeds, Champaign, Ill. U.S.A.) immature tassels at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation.

The SATMON003 library is generated from maize (B73×Mo17, Illinois Foundation Seeds, Champaign, Ill. U.S.A.) roots at the V6 developmental stage. Seeds are planted at a depth of approximately 3 cm in coil into 2-3 inch peat pots containing Metro 200 growing medium. After 2-3 weeks growth, the seedlings are transplanted into 10 inch pots containing the Metro 200 growing medium. Plants are watered daily before transplantation and approximately 3 times a week after transplantation. Peters 15-16-17 fertilizer is applied approximately three times per week after transplanting at a concentration of 150 ppm N. Two to three times during the life time of the plant from transplanting to flowering a total of approximately 900 mg Fe is added to each pot. Maize plants are grown in the green house in approximately 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6 leaf development stage. The root system is cut from maize plant and washed with water to free it from the soil. The tissue is then immediately frozen in liquid nitrogen. The harvested tissue is then stored at −80° C. until RNA preparation.

The SATMON004 cDNA library is generated from maize (B73×Mo17, Illinois Foundation Seeds, Champaign, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON005 cDNA library is generated from maize (B73×Mo17, Illinois Foundation Seeds, Champaign Ill., U.S.A.) root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation.

The SATMON006 cDNA library is generated from maize (B73×Mo17, Illinois Foundation Seeds, Champaign Ill., U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON007 cDNA library is generated from the primary root tissue of 5 day old maize (DK604, Dekalb Genetics, Dekalb, Ill. U.S.A.) seedlings. Seeds are planted on a moist filter paper on a covered tray that is kept in the dark until germination (one day). After germination, the trays, along with the moist paper, are moved to a greenhouse where the maize plants are grown in the greenhouse in 15 hr day/9 hr night cycles for approximately 5 days. The daytime temperature is approximately 80° F. and the nighttime temperature is approximately 70° F. Supplemental lighting is provided by 1000 W sodium vapor lamps. The primary root tissue is collected when the seedlings are 5 days old. At this stage, the primary root (radicle) is pushed through the coleorhiza which itself is pushed through the seed coat. The primary root, which is about 2-3 cm long, is cut and immediately frozen in liquid nitrogen and then stored at −80° C. until RNA preparation.

The SATMON008 cDNA library is generated from the primary shoot (coleoptile 2-3 cm) of maize (DK604, Dekalb Genetics, Dekalb, Ill. U.S.A.) seedlings which are approximately 5 days old. Seeds are planted on a moist filter paper on a covered tray that is kept in the dark until germination (one day). Then the trays containing the seeds are moved to a greenhouse at 15 hr daytime/9 hr nighttime cycles and grown until they are 5 days post germination. The daytime temperature is approximately 80° F. and the nighttime temperature is approximately 70° F. Tissue is collected when the seedlings are 5 days old. At this stage, the primary shoot (coleoptile) is pushed through the seed coat and is about 2-3 cm long. The coleoptile is dissected away from the rest of the seedling, immediately frozen in liquid nitrogen and then stored at −80° C. until RNA preparation.

The SATMON009 cDNA library is generated from maize (DK604, Dekalb Genetics, Dekalb, Ill. U.S.A.) leaves at the 8 leaf stage (V8 plant development stage). Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the 8-leaf development stage. The older more juvenile leaves, which are in a basal position, as well as the younger more adult leaves, which are more apical, are cut at the base of the leaves. The leaves are then pooled and then immediately transferred to liquid nitrogen containers in which the pooled leaves are crushed. The harvested tissue is then stored at −80° C. until RNA preparation.

The SATMON010 cDNA library is generated from maize (DK604, Dekalb Genetics, Dekalb, Ill. U.S.A.) root tissue at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the V8 development stage. The root system is cut from this mature maize plant and washed with water to free it from the soil. The tissue is immediately frozen in liquid nitrogen. The harvested tissue is then stored at −80° C. until RNA preparation.

The SATMON011 cDNA library is generated from undeveloped maize (DK604, Dekalb Genetics, Dekalb, Ill. U.S.A.) leaf at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The second youngest leaf which is at the base of the apical leaf of V6 stage maize plant is cut at the base and immediately transferred to liquid nitrogen containers in which the leaf is crushed. The harvested tissue is then stored at −80° C. until RNA preparation.

The SATMON012 cDNA library is generated from 2 day post germination maize (DK604, Dekalb Genetics, Dekalb, Ill. U.S.A.) seedlings. Seeds are planted on a moist filter paper on a covered tray that is kept in the dark until germination (one day). Then the trays containing the seeds are moved to the greenhouse and grown at 15 hr daytime/9 hr nighttime cycles until 2 days post germination. The daytime temperature is approximately 80° F. and the nighttime temperature is approximately 70° F. Tissue is collected when the seedlings are 2 days old. At the two day stage, the coleorhiza is pushed through the seed coat and the primary root (the radicle) is pierced the coleorhiza but is barely visible. Also, at this two day stage, the coleoptile is just emerging from the seed coat. The 2 days post germination seedlings are then immersed in liquid nitrogen and crushed. The harvested tissue is stored at −80° C. until preparation of total RNA.

The SATMON013 cDNA library is generated from apical maize (DK604, Dekalb Genetics, Dekalb, Ill. U.S.A.) meristem founder at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, the plant is at the 4 leaf stage. The lead at the apex of the V4 stage maize plant is referred to as the meristem founder. This apical meristem founder is cut, immediately frozen in liquid nitrogen and crushed. The harvested tissue is then stored at −80° C. until RNA preparation.

The SATMON014 cDNA library is generated from maize (DK604, Dekalb Genetics, Dekalb, Ill. U.S.A.) endosperm fourteen days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the maize plant ear shoots are ready for fertilization. At this stage, the ear shoots are enclosed in a paper bag before silk emergence to withhold the pollen. The ear shoots are pollinated and 14 days after pollination, the ears are pulled out and then the kernels are plucked out of the ears. Each kernel is then dissected into the embryo and the endosperm and the aleurone layer is removed. After dissection, the endosperms are immediately frozen in liquid nitrogen and then stored at −80° C. until RNA preparation.

The SATMON016 library is a maize (DK604, Dekalb Genetics, Dekalb, Ill. U.S.A.) sheath library collected at the V8 developmental stage. Seeds are planted in a depth of approximately 3 cm in solid into 2-3 inch pots containing Metro growing medium. After 2-3 weeks growth, they are transplanted into 10" pots containing the same. Plants are watered daily before transplantation and approximately the times a week after transplantation. Peters 15-16-17 fertilizer is applied approximately three times per week after transplanting, at a strength of 150 ppm N. Two to three times during the life time of the plant from transplanting to flowering, a total of approximately 900 mg Fe is added to each pot. Maize plants are grown in the green house in 15 hr day/9 hr night cycles. The daytime temperature is approximately 80° F. and the nighttime temperature is approximately 70° F.

Supplemental lighting is provided by 1000 W sodium vapor lamps. When the maize plants are at the V8 stage the 5$^{th}$ and 6$^{th}$ leaves from the bottom exhibit fully developed leaf blades. At the base of these leaves, the ligule is differentiated and the leaf blade is joined to the sheath. The sheath is dissected away from the base of the leaf then the sheath is frozen in liquid nitrogen and crushed. The tissue is then stored at −80° C. until RNA preparation.

The SATMON017 cDNA library is generated from maize (DK604, Dekalb Genetics, Dekalb, Ill. U.S.A.) embryo seventeen days after pollination. Seeds are planted at a depth of approximately 3 cm into 2-3 inch peat pots containing Metro 200 growing medium. After 2-3 weeks growth the seeds are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of maize plant, which are ready for fertilization, are enclosed in a paper bag before silk emergence to withhold the pollen. The ear shoots are fertilized and 21 days after pollination, the ears are pulled out and the kernels are plucked out of the ears. Each kernel is then dissected into the embryo and the endosperm and the aleurone layer is removed. After dissection, the embryos are immediately frozen in liquid nitrogen and then stored at −80° C. until RNA preparation.

The SATMON019 (Lib3054) cDNA library is generated from maize (DK604, Dekalb Genetics, Dekalb, Ill. U.S.A.) culm (stem) at the V8 developmental stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. When the maize plant is at the V8 stage, the 5th and 6th leaves from the bottom have fully developed leaf blades. The region between the nodes of the 5th and the sixth leaves from the bottom is the region of the stem that is collected. The leaves are pulled out and the sheath is also torn away from the stem. This stem tissue is completely free of any leaf and sheath tissue. The stem tissue is then frozen in liquid nitrogen and stored at −80° C. until RNA preparation.

The SATMON020 cDNA library is from a maize (DK604, Dekalb Genetics, Dekalb, Ill. U.S.A.) Hill Type II-Initiated Callus. Petri plates containing approximately 25 ml of Type II initiation media are prepared. This medium contains N6 salts and vitamins, 3% sucrose, 2.3 g/liter proline 0.1 g/liter enzymatic casein hydrolysate, 2 mg/liter 2,4-dichloro phenoxyacetic acid (2,4, D), 15.3 mg/liter AgNO$_3$ and 0.8% bacto agar and is adjusted to pH 6.0 before autoclaving. At 9-11 days after pollination, an ear with immature embryos measuring approximately 1-2 mm in length is chosen. The husks and silks are removed and then the ear is broken into halves and placed in an autoclaved solution of Clorox/TWEEN 20 sterilizing solution. Then the ear is rinsed with deionized water. Then each embryo is extracted from the kernel. Intact embryos are placed in contact with the medium, scutellar side up). Multiple embryos are plated on each plate and the plates are incubated in the dark at 25° C. Type II calluses are friable, can be subcultured with a spatula, frequently regenerate via somatic embryogenesis and are relatively undifferentiated. As seen in the microscope, the Tape II calluses show color ranging from translucent to light yellow and heterogeneity on with respect to embryoid structure as well as stage of embryoid development. Once Type II callus are formed, the calluses is transferred to type II callus maintenance medium without AgNO$_3$. Every 7-10 days, the callus is subcultured. About 4 weeks after embryo isolation the callus is removed from the plates and then frozen in liquid nitrogen. The harvested tissue is stored at −80° C. until RNA preparation.

The SATMON021 cDNA library is generated from the immature maize (DK604, Dekalb Genetics, Dekalb Ill., U.S.A.) tassel at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. As the maize plant enters the V8 stage, tassels which are 15-20 cm in length are collected and frozen in liquid nitrogen. The harvested tissue is stored at −80° C. until RNA preparation.

The SATMON022 cDNA library is generated from maize (DK604, Dekalb Genetics, Dekalb, Ill. U.S.A.) ear (growing silks) at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. *Zea mays* plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the plant is in the V8 stage. At this stage, some immature ear shoots are visible. The immature ear shoots (approximately 1 cm in length) are pulled out, frozen in liquid nitrogen and then stored at −80° C. until RNA preparation.

The SATMON23 cDNA library is generated from maize (DK604, Dekalb Genetics, Dekalb, Ill. U.S.A.) ear (growing silk) at the V8 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. When the tissue is harvested at the V8 stage, the length of the ear that is harvested is about 10-15 cm and the silks are just exposed (approximately 1 inch). The ear along with the silks is frozen in liquid nitrogen and then the tissue is stored at −80° C. until RNA preparation.

The SATMON024 cDNA library is generated from the immature maize (DK604, Dekalb Genetics, Dekalb, Ill. U.S.A.) tassel at the V9 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. As a maize plant enters the V9 stage, the tassel is rapidly developing and a 37 cm tassel along with the glume, anthers and pollen is collected and frozen in liquid nitrogen. The harvested tissue is stored at −80° C. until RNA preparation.

The SATMON025 cDNA library is from maize (DK604, Dekalb Genetics, Dekalb, Ill. U.S.A.) Hill Type II-Regenerated Callus. Type II callus is grown in initiation media as described for SATMON020 and then the embryoids on the surface of the Type II callus are allowed to mature and germinate. The 1-2 gm fresh weight of the soft friable type callus containing numerous embryoids are transferred to 100×15 mm petri plates containing 25 ml of regeneration media. Regeneration media consists of Murashige and Skoog (MS) basal salts, modified White's vitamins (0.2 g/liter glycine and 0.5 g/liter myo-inositoland 0.8% bacto agar (6SMS0D)). The plates are then placed in the dark after covering with parafilm. After 1 week, the plates are moved to a lighted growth chamber with 16 hr light and 8 hr dark photoperiod. Three weeks after plating the Type II callus to 6SMS0D, the callus exhibit shoot formation. The callus and the shoots are transferred to fresh 6SMS0D plates for another 2 weeks. The callus and the shoots are then transferred to petri plates with reduced sucrose (3SMSOD). Upon distinct formation of a root and shoot, the newly developed green plants are then removed out with a spatula and frozen in liquid nitrogen containers. The harvested tissue s then stored at −80° C. until RNA preparation.

The SATMON026 cDNA library is generated from maize (DK604, Dekalb Genetics, Dekalb, Ill. U.S.A.) juvenile/adult shift leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plants are at the 8-leaf development stage. Leaves are founded sequentially around the meristem over weeks of time and the older, more juvenile leaves arise earlier and in a more basal position than the younger, more adult leaves, which are in a more apical position. In a V8 plant, some leaves which are in the middle portion of the plant exhibit characteristics of both juvenile as well as adult leaves. They exhibit a yellowing color but also exhibit, in part, a green color. These leaves are termed juvenile/adult shift leaves. The juvenile/adult shift leaves (the 4th, 5th leaves from the bottom) are cut at the base, pooled and transferred to liquid nitrogen in which they are then crushed. The harvested tissue is then stored at −80° C. until RNA preparation.

The SATMON027 cDNA library is generated from 6 day maize (DK604, Dekalb Genetics, Dekalb, Ill. U.S.A.) leaves. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. *Zea mays* plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The older, more juvenile leaves, which are in a basal position, as well as the younger, more adult leaves, which are more apical, are all cut at the base of the leaves. All the leaves exhibit significant wilting. The leaves are then pooled and immediately transferred to liquid nitrogen containers in which the pooled leaves are then crushed. The harvested tissue is then stored at −80° C. until RNA preparation.

The SATMON028 cDNA library is generated from maize (DK604, Dekalb Genetics, Dekalb, Ill. U.S.A.) roots at the V8 developmental stage that are subject to six days water stress. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The root system is cut, shaken and washed to remove soil. Root tissue is then pooled and immediately transferred to liquid nitrogen containers in which the pooled leaves are then crushed. The harvested tissue is then stored at −80° C. until RNA preparation.

The SATMON029 cDNA library is generated from maize (DK604, Dekalb Genetics, Dekalb, Ill. U.S.A.) seedlings at the etiolated stage. Seeds are planted on a moist filter paper on a covered tray that is kept in the dark for 4 days at approximately 70° F. Tissue is collected when the seedlings are 4 days old. By 4 days, the primary root has penetrated the coleorhiza and is about 4-5 cm and the secondary lateral roots have also made their appearance. The coleoptile has also pushed through the seed coat and is about 4-5 cm long. The seedlings are frozen in liquid nitrogen and crushed. The harvested tissue is then stored at −80° C. until RNA preparation.

The SATMON030 cDNA library is generated from maize (DK604, Dekalb Genetics, Dekalb, Ill. U.S.A.) root tissue at the V4 plant development stage. Seeds are planted at a depth of approximately 3 cm into 2-3 inch peat pots containing Metro 200 growing medium. After 2-3 weeks growth, they are transplanted into 10 inch pots containing the same. Plants are watered daily before transplantation and approximately 3 times a week after transplantation. Peters 15-16-17 fertilizer is applied approximately three times per week after transplanting, at a strength of 150 ppm N. Two to three times during the life time of the plant, from transplanting to flowering, a total of approximately 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 sodium vapor lamps. Tissue is collected when the maize plant is at the 4 leaf development stage. The root system is cut from the mature maize plant and washed with water to free it from the soil. The tissue is then immediately frozen in liquid nitrogen. The harvested tissue is then stored at −80° C. until RNA preparation.

The SATMON031 cDNA library is generated from the maize (DK604, Dekalb Genetics, Dekalb, Ill. U.S.A.) leaf tissue at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the 4-leaf development stage. The third leaf from the bottom is cut at the base and immediately frozen in liquid nitrogen and crushed. The tissue is immediately frozen in liquid nitrogen. The harvested tissue is then stored at −80° C. until RNA preparation.

The SATMON033 cDNA library is generated from maize (DK604, Dekalb Genetics, Dekalb, Ill. U.S.A.) embryo tissue 13 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 13 days after pollination, the ears are pulled out and then the kernels are plucked out of the ears. Each kernel is then dissected into the embryo and the endosperm and the aleurone layer is removed. After dissection, the embryos are immediately frozen in liquid nitrogen and then stored at −80° C. until RNA preparation.

The SATMON034 cDNA library is generated from cold stressed maize (DK604, Dekalb Genetics, Dekalb, Ill. U.S.A.) seedlings. Seeds are planted on a moist filter paper on a covered tray that is kept on at 10° C. for 7 days. After 7 days, the temperature is shifted to 15° C. for one day until germination of the seed. Tissue is collected once the seedlings are 1 day old. At this point, the coleorhiza has just pushed out of the seed coat and the primary root is just making its appearance. The coleoptile has not yet pushed completely through the seed coat and is also just making its appearance. These 1 day old cold stressed seedlings arc frozen in liquid nitrogen and crushed. The harvested tissue is then stored at −80° C. until RNA preparation.

The SATMON-001 (Lib36, Lib83, Lib84) cDNA library is generated from maize leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V8 stage. The older more juvenile leaves in a basal position was well as the younger more adult leaves which are more apical are all cut at the base, pooled and frozen in liquid nitrogen. The harvested tissue is then stored at −80° C. until RNA preparation.

The SATMONN01 cDNA library is generated from maize (B73, Illinois Foundation Seeds, Champaign, Ill. U.S.A.)n-ormalized immature tassels at the V6 plant development stage normalized tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated DATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The SATMONN04 cDNA library is generated from maize (B73×Mo17, Illinois Foundation Seeds, Champaign, Ill. U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The SATMON05 cDNA library is generated from maize (B73×Mo17, Illinois Foundation Seeds, Champaign Ill., U.S.A.) normalized root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation. The single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The SATMONN06 cDNA library is generated from maize (B73 ×Mo17, Illinois Foundation Seeds, Champaign Ill., U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The CMZ029 (SATMON036) cDNA library is generated from maize (DK604, Dekalb Genetics, Dekalb, Ill. U.S.A.) endosperm 22 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 22 days after pollination, the ears are pulled out and then the kernels are plucked out of the ears. Each kernel is then dissected into the embryo and the endosperm and the alurone layer is removed. After dissection, the endosperms are immediately frozen in liquid nitrogen and then stored at −80° C. until RNA preparation.

The CMz030 (Lib143) cDNA library is generated from maize seedling tissue two days post germination. Seeds are planted on a moist filter paper on a covered try that is keep in the dark until germination. The trays are then moved to the bench top at 15 hr daytime/9 hr nighttime cycles for 2 days post-germination. The day time temperature is 80° F. and the nighttime temperature is 70° F. Tissue is collected when the seedlings are 2 days old. At this stage, the colehrhiza has pushed through the seed coat and the primary root (the radicle) is just piercing the colehrhiza and is barely visible. The seedlings are placed at 42° C. for 1 hour. Following the heat shock treatment, the seedlings are immersed in liquid nitrogen and crushed. The harvested tissue is stored at −80° until RNA preparation.

The CMz031 (Lib148) cDNA library is generated from maize pollen tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag to withhold pollen. Twenty-one days after pollination, prior to removing the ears, the paper bag is shaken to collect the mature pollen. The mature pollen is immediately frozen in liquid nitrogen containers and the pollen is crushed. The harvested tissue is then stored at −80° C. until RNA preparation.

The CMz033 (Lib189) cDNA library is generated from maize pooled leaf tissue. Samples are harvested from open pollinated plants. Tissue is collected from maize leaves at the anthesis stage. The leaves are collect from from 10-12 plants and frozen in liquid nitrogen. The harvested tissue is then stored at −80° C. until RNA preparation.

The CMz034 (Lib3060) cDNA library is generated from maize mature tissue at 40 days post pollination plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from leaves located two leaves below the ear leaf. This sample represents those genes expressed during onset and early stages of leaf senescence. The leaves are pooled and immediately transferred to liquid nitrogen. The harvested tissue is then stored at −80° C. until RNA preparation.

The CMz035 (Lib3061) cDNA library is generated from maize endosperm tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80°F and the nighttime temperature is approximately 70°F. Supplemental lighting is provided by 1000 W sodium vapor lamps. Tissue is collected from V10+ stage plants. The ear shoots, which are ready for fertilization, are enclosed in a paper bag prior to silk emergence to withhold pollen. Thirty-two days after pollination, the ears are pulled out and the kernels are removed from the cob. Each kernel is dissected into the embryo and the endosperm and the aleurone layer is removed. After dissection, the endosperms are immediately transferred to liquid nitrogen. The harvested tissue is then stored at −80°C until RNA preparation.

The CMz036 (Lib3062) cDNA library is generated from maize husk tissue at the 8 week old plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from 8 week old plants. The husk is separated from the ear and immediately transferred to liquid nitrogen containers. The harvested tissue is then stored at −80° C. until RNA preparation.

The CMz037 (Lib3059) cDNA library is generated from maize pooled kernal at 12-15 days after pollienation plant development stage. Sample were collected from field grown material. Whole kernals from hand pollinated (control pollination) are harvested as whole ears and immediately frozen on dry ice. Kernels from 10-12 ears were pooled and ground together in liquid nitrogen. The harvested tissue is then stored at −80° C. until RNA preparation.

The CMz039 (Lib3066) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately frozen in liquid nitrogen. The harvested tissue is then stored at −80° C. until RNA preparation.

The CMz040 (Lib3067) cDNA library is generated from maize kernel tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag before silk emergence to withhold pollen. Five to eight days after controlled pollination. The ears are pulled and the kernels removed. The kernels are immediately frozen in liquid nitrogen. The harvested kernels tissue is then stored at −80° C. until RNA preparation. This sample represents gene expressed in early kernel development, during periods of cell division, amyloplast biogenesis and early carbon flow across the material to filial tissue.

The CMz041 (Lib3068) cDNA library is generated from maize pollen germinating silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants when the ear shoots are ready for fertilization at the silk emergence stage. The emerging silks are pollinated with an excess of pollen under controlled pollination conditions in the green house. Eighteen hours after pollination the silks are removed from the ears and immediately frozen in liquid nitrogen containers. This sample represents genes expressed in both pollen and silk tissue early in pollination. The harvested tissue is then stored at −80° C. until RNA preparation.

The CMz042 (Lib3069) cDNA library is generated from maize ear tissue excessively pollinated at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants and the ear shoots which are ready for fertilization are at the silk emergence stage. The immature ears are pollinated with an excess of pollen under controlled pollination conditions. Eighteen hours post-pollination, the ears are removed and immediately transferred to liquid nitrogen containers. The harvested tissue is then stored at −80° C. until RNA preparation.

The CMz044 (Lib3075) cDNA library is generated from maize microspore tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature anthers from 7 week old tassels. The immature anthers are first dissected from the 7 week old tassel with a scalpel on a glass slide covered with water. The microspores (immature pollen) are released into the water and are recovered by centrifugation. The microspore suspension is immediately frozen in liquid nitrogen. The harvested tissue is then stored at −80° C. until RNA preparation.

The CMz045 (Lib3076) cDNA library is generated from maize immature ear megaspore tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature ear (megaspore) obtained from 7 week old plants. The immature ears are harvested from the 7 week old plants and are approximately 2.5 to 3 cm in length. The kernels are removed from the cob immediately frozen in liquid nitrogen. The harvested tissue is then stored at −80° C. until RNA preparation.

The CMz047 (Lib3078) cDNA library is generated from maize $CO_2$ treated high-exposure shoot tissue at the V10+ plant development stage. RX601 maize seeds are sterilized for i minute with a 10% clorox solution. The seeds are rolled in germination paper, and germinated in 0.5 mM calcium sulfate solution for two days at 30° C. The seedlings are planted at a depth of approximately 3 cm into 2-3 inch peat pots containing Metro 200 growing medium at a rate of 2-3 seedlings per pot. Twenty pots are placed into a high $CO_2$ environment (approximately 1000 ppm $CO_2$). Twenty plants were grown under ambient greenhouse $CO_2$ (approximately 450 ppm $CO_2$). Plants are watered daily before transplantation and three times a week after transplantation. Peters 20-20-20 fertilizer is also lightly applied. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. At ten days post planting, the shoots from both atmosphere are frozen in liquid nitrogen and lightly ground. The roots are washed in deionized water to remove the support media and the tissue is immediately transferred to liquid nitrogen containers. The harvested tissue is then stored at −80° C. until RNA preparation.

The CMz048 (Lib3079) cDNA library is generated from maize basal endosperm transfer layer tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ maize plants. The ear shoots, which are ready for fertilization, are enclosed in a paper bag prior to silk emergence, to withhold the pollen. Kernels are harvested at 12 days post-pollination and placed on wet ice for dissection. The kernels are cross sectioned laterally, dissecting just above the pedicel region, including 1-2 mm of the lower endosperm and the basal endosperm transfer region. The pedicel and lower endosperm region containing the basal endosperm transfer layer is pooled and immediately frozen in liquid nitrogen. The harvested tissue is then stored at −80° C. until RNA preparation.

The CMz049(Lib3088) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately transferred to liquid nitrogen container. The harvested tissue is then stored at −80° C. until RNA preparation.

The CMz050 (Lib3114) cDNA library is generated from maize silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is beyond the 10-leaf development stage and the ear shoots are approximately 15-20 cm in length. The ears are pulled and silks are separated from the ears and immediately transferred to liquid nitrogen containers. The harvested tissue is then stored at −80° C. until RNA preparation.

The SOYMON001 cDNA library is generated from soybean cultivar Asgrow 3244 (Asgrow Seed Company, Des Moines, Iowa U.S.A.) total leaf tissue at the V4 plant development stage. Leaf tissue from 38, field grown V4 stage plants is harvested from the $4^{th}$ node. Leaf tissue is removed from the plants and immediately frozen in dry-ice. The harvested tissue is then stored at −80° C. until RNA preparation.

The SOYMON002 cDNA library is generated from soybean cultivar Asgrow 3244 (Asgrow Seed Company, Des Moines, Iowa U.S.A.) root tissue at the V4 plant development stage. Root tissue from 76, field grown V4 stage plants is harvested. The root systems is cut from the soybean plant and washed with water to free it from the soil and immediately frozen in dry-ice. The harvested tissue is then stored at −80° C. until RNA preparation.

The SOYMON003 cDNA library is generated from soybean cultivar Asgrow 3244 (Asgrow Seed Company, Des Moines, Iowa U.S.A.) seedling hypocotyl axis tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation.

The SOYMON004 cDNA library is generated from soybean cultivar Asgrow 3244 (Asgrow Seed Company, Des Moines, Iowa U.S.A.) seedling cotyledon tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation.

The SOYMON005 cDNA library is generated from soybean cultivar Asgrow 3244 (Asgrow Seed Company, Des Moines, Iowa U.S.A.) seedling hypocotyl axis tissue harvested 6 hour post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after the start of imbibition. The 6 hours after imbibition samples are separated into 3 collections after removal of any adhering seed coat. The 6 hours after imbibition sample is collected over the course of approximately 2 hours starting at 6 hours post imbibition. At the 6 hours after imbibition stage, not all cotyledons have become fully hydrated and germination, or radicle protrusion, has not occurred. The seedlings are washed in water to remove soil, hypocotyl axis harvested and immediately frozen in liquid nitrogen. The harvested tissue is then stored at −80° C. until RNA preparation.

The SOYMON006 cDNA library is generated from soybean cultivar Asgrow 3244 (Asgrow Seed Company, Des Moines, Iowa U.S.A.) seedling cotyledons tissue harvest 6 hour post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after imbibition. The 6 hours after imbibition samples are separated into 3 collections after removal of any adhering seed coat. The 6 hours after imbibition sample is collected over the course of approximately 2 hours starting at 6 hours post-imbibition. At the 6 hours after imbibition, not all cotyledons have become fully hydrated and germination or radicle protrusion, have not occurred. The seedlings are washed in water to remove soil, cotyledon harvested and immediately frozen in liquid nitrogen. The harvested tissue is then stored at −80° C. until RNA preparation.

The SOYMON007 cDNA library is generated from soybean cultivar Asgrow 3244 (Asgrow Seed Company, Des Moines, Iowa U.S.A.) seed tissue harvested 25 and 35 days post-flowering. Seed pods from field grown plants are harvested 25 and 35 days after flowering and the seeds extracted from the pods. Approximately 4.4 g and 19.3 g of seeds are harvested from the respective seed pods and immediately frozen in dry ice. The harvested tissue is then stored at −80° C. until RNA preparation.

The SOYMON008 cDNA library is generated from soybean cultivar Asgrow 3244 (Asgrow Seed Company, Des Moines, Iowa U.S.A.) leaf tissue harvested from 25 and 35 days post-flowering plants. Total leaf tissue is harvested from field grown plants. Approximately 19 g and 29 g of leaves are harvested from the fourth node of the plant 25 and 35 days post-flowering and immediately frozen in dry ice. The harvested tissue is then stored at −80° C. until RNA preparation.

The SOYMON009 cDNA library is generated from soybean cutlivar C1944 (USDA Soybean Germplasm Collection, Urbana, Ill. U.S.A.) pod and seed tissue harvested 15 days post-flowering. Pods from field grown plants are harvested 15 days post-flowering. Approximately 3 g of pod tissue is harvested and immediately frozen in dry-ice. The harvested tissue is then stored at −80° C. until RNA preparation.

The SOYMON010 cDNA library is generated from soybean cultivar C1944 (USDA Soybean Germplasm Collection, Urbana, Ill. U.S.A.) seed tissue harvested 40 days post-flowering. Pods from field grown plants are harvested 40 days post-flowering. Pods and seeds are separated, approximately 19 g of seed tissue is harvested and immediately frozen in dry-ice. The harvested tissue is then stored at −80° C. until RNA preparation.

The SOYMON011 cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation.

The SOYMON012 cDNA library is generated from soybean cultivar Asgrow 3244 (Asgrow Seed Company, Des Moines, Iowa U.S.A.) leaf tissue. Leaves from field grown plants are harvested from the fourth node 15 days post-flowering. Approximately 12 g of leaves are harvested and immediately frozen in dry ice. The harvested tissue is then stored at −80° C. until RNA preparation.

The SOYMON013 cDNA library is generated from soybean cultivar Asgrow 3244 (Asgrow Seed Company, Des Moines, Iowa U.S.A.) root and nodule tissue. Approximately, 28 g of root tissue from field grown plants is harvested 15 days post-flowering. The root system is cut from the soybean plant, washed with water to free it from the soil and immediately frozen in dry-ice. The harvested tissue is then stored at −80° C. until RNA preparation.

The SOYMON014 cDNA library is generated from soybean cultivar Asgrow 3244 (Asgrow Seed Company, Des Moines, Iowa U.S.A.) seed tissue harvested 25 and 35 days after flowering. Seed pods from field grown plants are harvested 15 days after flowering and the seeds extracted from the pods. Approximately 5 g of seeds are harvested from the respective seed pods and immediately frozen in dry ice. The harvested tissue is then stored at −80° C. until RNA preparation.

The SOYMON015 cDNA is generated from soybean cultivar Asgrow 3244 (Asgrow Seed Company, Des Moines, Iowa U.S.A.) seed tissue harvested 45 and 55 days post-flowering. Seed pods from field grown plants are harvested 45 and 55 days after flowering and the seeds extracted from the pods. Approximately 19 g and 31 g of seeds are harvested from the respective seed pods and immediately frozen in dry ice. The harvested tissue is then stored at −80° C. until RNA preparation.

The SOYMON016 cDNA library is generated from soybean cultivar Asgrow 3244 (Asgrow Seed Company, Des Moines, Iowa U.S.A.) root tissue. Approximately, 61 g and 38 g of root tissue from field grown plants is harvested 25 and 35 days post-flowering is harvested. The root system is cut from the soybean plant and washed with water to free it from the soil. The tissue is placed in 14 ml polystyrene tubes and immediately frozen in dry-ice. The harvested tissue is then stored at −80° C. until RNA preparation.

The SOYMON017 cDNA library is generated from soybean cultivar Asgrow 3244 (Asgrow Seed Company, Des Moines, Iowa U.S.A.) root tissue. Approximately 28 g of root tissue from field grown plants is harvested 45 and 55 days post-flowering. The root system is cut from the soybean plant, washed with water to free it from the soil and immediately frozen in dry-ice. The harvested tissue is then stored at −80° C. until RNA preparation.

The SOYMON018 cDNA is generated from soybean cultivar Asgrow 3244 (Asgrow Seed Company, Des Moines, Iowa U.S.A.) leaf tissue harvested 45 and 55 days post-flowering. Leaves from field grown plants are harvested 45 and 55 days after flowering from the fourth node. Approximately 27 g and 33 g of seeds are harvested from the respective seed pods and immediately frozen in dry ice. The harvested tissue is then stored at −80° C. until RNA preparation.

The SOYMON019 cDNA library is generated from soybean cultivars Cristalina (USDA Soybean Germplasm Collection, Urbana, Ill. U.S.A.) and FT108 (Monsoy, Brazil) (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation.

The SOYMON020 cDNA is generated from soybean cultivar Asgrow 3244 (Asgrow Seed Company, Des Moines, Iowa U.S.A.) seed tissue harvested 65 and 75 days post-flowering. Seed pods from field grown plants are harvested 45 and 55 days after flowering and the seeds extracted from the pods. Approximately 14 g and 31 g of seeds are harvested from the respective seed pods and immediately frozen in dry ice. The harvested tissue is then stored at −80° C. until RNA preparation.

The SOYMON021 cDNA library is generated from Soybean Cyst Nematode-resistant soybean cultivar Hartwig (USDA Soybean Germplasm Collection, Urbana, Ill. U.S.A.) root tissue. Plants are grown in tissue culture at room temperature. At approximately 6 weeks post-germination, the plants are exposed to sterilized Soybean Cyst Nematode eggs. Infection is then allowed to progress for 10 days. After the 10 day infection process, the tissue is harvested. Agar from the culture medium and nematodes are removed and the root tissue is immediately frozen in dry ice. The harvested tissue is then stored at −80° C. until RNA preparation.

The SOYMON022 (Lib3030) cDNA library is generated from soybean cultivar Asgrow 3244 (Asgrow Seed Company, Des Moines, Iowa U.S.A.) partially opened flower tissue. Partially to fully opened flower tissue is harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. A total of 3 g of flower tissue is harvested and immediately frozen in dry ice. The harvested tissue is then stored at −80° C. until RNA preparation.

The SOYMON023 cDNA library is generated from soybean genotype BW211S Null (Tohoku University, Morioka, Japan) seed tissue harvested 15 and 40 days post-flowering. Seed pods from field grown plants are harvested 15 and 40 days post-flowering and the seeds extracted from the pods. Approximately 0.7 g and 14.2 g of seeds are harvested from the respective seed pods and immediately frozen in dry ice. The harvested tissue is then stored at −80° C. until RNA preparation.

The SOYMON024 cDNA library is generated from soybean cultivar Asgrow 3244 (Asgrow Seed Company, Des Moines, Iowa U.S.A.) internode-2 tissue harvested 18 days post-imbition. Seeds are planted at a depth of approximately 2 cm into 2-3 inch peat pots containing Metromix 350 medium. The plants are grown in a greenhouse for 18 days after the start of imbibition at ambient temperature. Soil is checked and watered daily to maintain even moisture conditions. Stem tissue is harvested 18 days after the start of imbibition. The samples are divided into hypocotyl and internodes 1 through 5. The fifth internode contains some leaf bud material. Approximately 3 g of each sample is harvested and immediately frozen in dry ice. The harvested tissue is then stored at −80° C. until RNA preparation.

The SOYMON025 cDNA library is generated from soybean cultivar Asgrow 3244 (Asgrow Seed Company, Des Moines, Iowa U.S.A.) leaf tissue harvested 65 days post-flowering. Leaves are harvested from the fourth node of field grown plants 65 days post-flowering. Approximately 18.4 g of leaf tissue is harvested and immediately frozen in dry ice. The harvested tissue is then stored at −80° C. until RNA preparation.

SOYMON026 cDNA library is generated from soybean cultivar Asgrow 3244 (Asgrow Seed Company, Des Moines, Iowa U.S.A.) root tissue harvested 65 and 75 days post-flowering. Approximately 27 g and 40 g of root tissue from field grown plants is harvested 65 and 75 days post-flowering. The root system is cut from the soybean plant, washed with water to free it from the soil and immediately frozen in dry-ice. The harvested tissue is then stored at −80° C. until RNA preparation.

The SOYMON027 cDNA library is generated from soybean cultivar Asgrow 3244 (Asgrow Seed Company, Des Moines, Iowa U.S.A.) seed tissue harvested 25 days post-flowering. Seed pods from field grown plants are harvested 25 days post-flowering and the seeds extracted from the pods. Approximately 17 g of seeds are harvested from the seed pods and immediately frozen in dry ice. The harvested tissue is then stored at −80° C. until RNA preparation.

The SOYMON028 cDNA library is generated from soybean cultivar Asgrow 3244 (Asgrow Seed Company, Des Moines, Iowa U.S.A.) drought-stressed root tissue. The plants are grown in an environmental chamber under 12 hr daytime/12 hr nighttime cycles. The daytime temperature is approximately 29° C. and the nighttime temperature 24° C. Soil is checked and watered daily to maintain even moisture conditions. At the R3 stage of development, water is withheld from half of the plant collection (drought stressed population). After 3 days, half of the plants from the drought stressed condition and half of the plants from the control population are harvested. After another 3 days (6 days post drought induction) the remaining plants are harvested. A total of 27 g and 40 g of root tissue is harvested and immediately frozen in dry ice. The harvested tissue is then stored at −80° C. until RNA preparation.

The SOYMON029 cDNA library is generated from Soybean Cyst Nematode-resistant soybean cultivar PI07354 (USDA Soybean Germplasm Collection, Urbana, Ill. U.S.A.) root tissue. Late fall to early winter greenhouse grown plants are exposed to Soybean Cyst Nematode eggs. At 10 days post-infection, the plants are uprooted, rinsed briefly and the roots frozen in liquid nitrogen. Approximately 20 grams of root tissue is harvested from the infected plants. The harvested tissue is then stored at −80° C. until RNA preparation.

The SOYMON030 cDNA library is generated from soybean cultivar Asgrow 3244 (Asgrow Seed Company, Des Moines, Iowa U.S.A.) flower bud tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. A total of 100 mg of flower buds are harvested and immediately frozen in liquid nitrogen. The harvested tissue is then stored at −80° C. until RNA preparation.

The SOYMON031 cDNA library is generated from soybean cultivar Asgrow 3244 (Asgrow Seed Company, Des Moines, Iowa U.S.A.) carpel and stamen tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. Flowers are dissected to separate petals, sepals and reproductive structures (carpels and stamens). A total of 300 mg of carpel and stamen tissue are harvested and immediately frozen in liquid nitrogen. The harvested tissue is then stored at −80° C. until RNA preparation.

The SOYMON032 cDNA library is prepared from the Asgrow cultivar A4922 (Asgrow Seed Company, Des Moines, Iowa U.S.A.) rehydrated dry soybean seed meristem tissue. Surface sterilized seeds are germinated in liquid media for 24 hours. The seed axis is then excised from the barely germinating seed, placed on tissue culture media and incubated overnight at 20° C. in the dark. The supportive tissue is removed from the explant prior to harvest. Approximately 570 mg of tissue is harvested and frozen in liquid nitrogen. The harvested tissue is then stored at −80° C. until RNA preparation.

The SOYMON033 cDNA library is generated from soybean cultivar Asgrow 3244 (Asgrow Seed Company, Des Moines, Iowa U.S.A.) heat-shocked seedling tissue without cotyledons. Seeds are imbibed and germinated in vermiculite for 2 days under constant illumination. After 48 hours, the seedlings are transferred to an incubator set at 40° C. under constant illumination. After 30, 60 and 180 minutes seedlings are harvested and dissected. A portion of the seedling consisting of the root, hypocotyl and apical hook is frozen in liquid nitrogen and stored at −80° C. The seedlings after 2 days of imbibition are beginning to emerge from the vermiculite surface. The apical hooks are dark green in appearance. Total RNA and poly $A^+$ RNA is prepared from equal amounts of pooled tissue.

The SOYMON034 cDNA library is generated from soybean cultivar Asgrow 3244 (Asgrow Seed Company, Des Moines, Iowa U.S.A.) cold-shocked seedling tissue without cotyledons. Seeds are imbibed and germinated in vermiculite for 2 days under constant illumination. After 48 hours, the seedlings are transferred to a cold room set at 5° C. under constant illumination. After 30, 60 and 180 minutes seedlings are harvested and dissected. A portion of the seedling consisting of the root, hypocotyl and apical hook is frozen in liquid nitrogen and stored at −80° C. The seedlings after 2 days of imbibition are beginning to emerge from the vermiculite surface. The apical hooks are dark green in appearance.

The SOYMON035 cDNA library is generated from soybean cultivar Asgrow 3244 (Asgrow Seed Company, Des Moines, Iowa U.S.A.) seed coat tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are harvested from mid to nearly full maturation (seed coats are not yellowing). The entire embryo proper is removed from the seed coat sample and the seed coat tissue are harvested and immediately frozen in liquid nitrogen. The harvested tissue is then stored at −80° C. until RNA preparation.

The SOYMON036 cDNA library is generated from soybean cultivars PI171451, PI227687 and PI229358 (USDA Soybean Germplasm Collection, Urbana, Ill. U.S.A.) insect challenged leaves. Plants from each of the three cultivars are grown in screenhouse conditions. The screenhouse is divided in half and one half of the screenhouse is infested with soybean looper and the other half infested with velvetbean caterpillar. A single leaf is taken from each of the representative plants at 3 different time points, 11 days after infestation, 2 weeks after infestation and 5 weeks after infestation and immediately frozen in liquid nitrogen. The harvested tissue is then stored at −80° C. until RNA preparation. Total RNA and poly A+ RNA is isolated from pooled tissue consisting of equal quantities of all 18 samples (3 genotypes×3 sample times×2 insect genotypes).

The SOYMON037 cDNA library is generated from soybean cultivar A3244 (Asgrow Seed Company, Des Moines, Iowa U.S.A.) etiolated axis and radical tissue. Seeds are planted in moist vermiculite, wrapped and kept at room temperature in complete darkness until harvest. Etiolated axis and hypocotyl tissue is harvested at 2, 3 and 4 days postplanting. A total of 1 gram of each tissue type is harvested at 2, 3 and 4 days after planting and immediately frozen in liquid nitrogen. The harvested tissue is then stored at −80° C. until RNA preparation.

The SOYMON038 cDNA library is generated from soybean variety Asgrow A3237 (Asgrow Seed Company, Des Moines, Iowa U.S.A.) rehydrated dry seeds. Explants are prepared for transformation after germination of surface-sterilized seeds on solid tissue media. After 6days, at 28° C. and 18 hours of light per day, the germinated seeds are cold shocked at 4° C. for 24 hours. Meristemic tissue and part of the hypocotyl is remove and cotyledon excised. The prepared explant is then wounded for *Agrobacterium* infection. The 2 grams of harvested tissue is frozen in liquid nitrogen and stored at −80° C. until RNA preparation.

The Soy51 (LIB3027) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The Soy52 (LIB3028) cDNA library is generated from normalized flower DNA. Single stranded DNA representing approximately $1 \times 10^6$ colony forming units of SOYMON022 harvested tissue is used as the starting material for normalization. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The Soy53 (LIB3039) cDNA library is generated from soybean cultivar Asgrow 3244 (Asgrow Seed Company, Des Moines, Iowa U.S.A.) seedling shoot apical meristem tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Apical tissue is harvested from seedling shoot meristem tissue, 7-8 days after the start of imbibition. The apex of each seedling is dissected to include the fifth node to the apical meristem. The fifth node corresponds to the third trifoliate leaf in the very early stages of development. Stipules completely envelop the leaf primordia at this time. A total of 200 mg of apical tissue is harvested and immediately frozen in liquid nitrogen. The harvested tissue is then stored at −80° C. until RNA preparation.

The Soy54 (LIB3040) cDNA library is generated from soybean cultivar Asgrow 3244 (Asgrow Seed Company, Des Moines, Iowa U.S.A.) heart to torpedo stage embryo tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected and embryos removed from surrounding endosperm and maternal tissues. Embryos from globular to young torpedo stages (by corresponding analogy to *Arabidopsis*) are collected with a bias towards the middle of this spectrum. Embryos which are beginning to show asymmetric development of cotyledons are considered the upper developmental boundary for the collection and are excluded. A total of 12 mg embryo tissue is frozen in liquid nitrogen. The harvested tissue is stored at −80° C. until RNA preparation.

Soy55 (LIB3049) cDNA library is generated from soybean cultivar Asgrow 3244 (Asgrow Seed Company, Des Moines, Iowa U.S.A.) young seed tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected from very young pods (5 to 15 days after flowering). A total of 100 mg of seeds are harvested and frozen in liquid nitrogen. The harvested tissue is stored at −80° C. until RNA preparation.

Soy56 (LIB3029) cDNA library is prepared from equal amounts tissue harvested from SOYMON007, SOYMON015 and SOYMON020 prepared tissue. Single stranded and double stranded DNA representing approximately 1×10$^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are not converted to double stranded form and represent a non-normalized seed pool for comparison to Soy51 cDNA libraries.

TheSoy58 (LIB3050) cDNA library is generated from soybean cultivar Asgrow 3244 (Asgrow Seed Company, Des Moines, Iowa U.S.A.) drought stressed root tissue subtracted from control root tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. At the R3 stage of the plant drought is induced by withholding water. After 3 and 6 days root tissue from both drought stressed and control (watered regularly) plants are collected and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (D-nabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 μl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.).

The Soy59 (LIB3051) cDNA library is generated from soybean cultivar Asgrow 3244 (Asgrow Seed Company, Des Moines, Iowa U.S.A.) endosperm tissue. Seeds are germinated on paper towels under laboratory ambient light conditions. At 8, 10 and 14 hours after imbibition, the seed coats are harvested. The endosperm consists of a very thin layer of tissue affixed to the inside of the seed coat. The seed coat and endosperm are frozen immediately after harvest in liquid nitrogen. The harvested tissue is stored at −80° C. until RNA preparation.

The Soy60 (LIB3072) cDNA library is generated from soybean cultivar Asgrow 3244 (Asgrow Seed Company, Des Moines, Iowa U.S.A.) drought stressed seed plus pod subtracted from control seed plus pod tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.).

The Soy61 (LIB3073) cDNA library is generated from soybean cultivar Asgrow 3244 (Asgrow Seed Company, Des Moines, Iowa U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.). For this library's construction, the eighth fraction of the cDNA size fractionation step was used for ligation.

The Soy62 (LIB3074) cDNA library is generated from soybean cultivar Asgrow 3244 (Asgrow Seed Company, Des Moines, Iowa U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.). For this library's construction, the ninth fraction of the cDNA size fractionation step was used for ligation.

The Soy65 (LIB3107) 07cDNA library is generated from soybean cultivar Asgrow 3244 (Asgrow Seed Company, Des Moines, Iowa U.S.A.) drought-stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Plants are irrigated with 15-16-17 Peter's Mix. At the R3 stage of development, drought is imposed by withholding water. At 3, 4, 5 and 6 days, tissue is harvested and wilting is not obvious until the fourth day. Abscission layers from reproductive organs are harvested by cutting less than one millimeter proximal and distal to the layer and immediately frozen in liquid nitrogen. The harvested tissue is stored at −80° C. until RNA preparation.

The Soy66 (LIB3109) cDNA library is generated from soybean cultivar Asgrow 3244 (Asgrow Seed Company, Des Moines, Iowa U.S.A.) non-drought stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Plants are irrigated with 15-16-17 Peter's Mix. At 3, 4, 5 and 6 days, control abscission layer tissue is harvested. Abscission layers from reproductive organs are harvested by cutting less than one millimeter proximal and distal to the layer and immediately frozen in liquid nitrogen. The harvested tissue is stored at −80° C. until RNA preparation.

Soy67 (LIB3065) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. Captured hybrids are eluted with water.

Soy68 (LIB3052) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. Captured hybrids are eluted with water.

Soy69 (LIB3053) cDNA library is generated from soybean cultivars Cristalina (USDA Soybean Germplasm Collection, Urbana, Ill. U.S.A.) and FT108 (Monsoy, Brazil) (tropical germ plasma) normalized leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

Soy70 (LIB3055) cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation.

Soy71 (LIB3056) cDNA library is generated from soybean cultivars Cristalina and FT108 (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation.

Soy72 (LIB3093) cDNA library is generated from soybean cultivar Asgrow 3244 (Asgrow Seed Company, Des Moines, Iowa U.S.A.) drought stressed leaf control tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.).

Soy73 (LIB3093) cDNA library is generated from soybean cultivar Asgrow 3244 (Asgrow Seed Company, Des Moines, Iowa U.S.A.) drought stressed leaf subtracted from control tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.).

The Soy76 (Lib3106) cDNA library is generated from soybean cultivar Asgrow 3244 (Asgrow Seed Company, Des Moines, Iowa U.S.A.) jasmonic acid and arachidonic treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. Arachidonic treated seedlings are sprayed with 1 m/ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA from the arachidonic treated seedlings is isolated separately. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.). Fraction 10 of the size fractionated cDNA is ligated into the pSPORT vector (Invitrogen, Carlsbad Calif. U.S.A.) in order to capture some of the smaller transcripts characteristic of antifungal proteins.

Soy77 (LIB3108) cDNA library is generated from soybean cultivar Asgrow 3244 (Asgrow Seed Company, Des Moines, Iowa U.S.A.) jasmonic acid control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. Arachidonic treated seedlings are sprayed with 1 m/ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA from the arachidonic treated seedlings is isolated separately. For subtraction, target cDNA is made from the jasmonic acid treated tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.). Fraction 10 of the size fractionated cDNA is ligated into the pSPORT vector in order to capture some of the smaller transcripts characteristic of antifungal proteins.

The Lib9 cDNA library is prepared from *Arabidopsis thaliana*, Columbia ecotype, leaf tissue. Wild type *Arabidopsis thaliana* seeds are planted in commonly used planting pots and grown in an environmental chamber. Leaf blades were cut with sharp scissors at seven weeks after planting. The tissue was immediately frozen in liquid nitrogen. The harvested tissue is stored at −80° C. until RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib22 cDNA library is prepared from *Arabidopsis thaliana* Columbia ecotype, root tissue. Wild type *Arabidopsis thaliana* seeds are planted in commonly used planting pots and grown in an environmental chamber. After 5-6 weeks the plants are in the reproductive growth phase. Stems are bolting from the base of the plants. After 7 weeks, more stems, floral buds appear, and a few flowers are starting to open. The 7-week old plants are rinsed intensively by tope water remove dirt from the roots, and blotted by paper towel. The tissues are immediately frozen in liquid nitrogen. The harvested tissue is stored at −80° C. until RNA preparation.

The Lib23 cDNA library is prepared from *Arabidopsis thaliana*, Columbia ecotype, stem tissue. Wild type *Arabidopsis thaliana* seeds are planted in commonly used planting pots and grown in an environmental chamber. Stems were collected seven to eight weeks after planting by cutting the stems from the base and cutting the top of the plant to remove the floral tissue. The tissue was immediately frozen in liquid nitrogen and stored at −80' C. until total RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib24 cDNA library is prepared from *Arabidopsis thaliana*, Columbia ecotype, flower bud tissue. Wild type *Arabidopsis thaliana* seeds are planted in commonly used planting pots and grown in an environmental chamber. Flower buds are green and unopened and harvested about seven weeks after planting. The tissue is immediately frozen in liquid nitrogen. The harvested tissue is stored at −80' C. until total RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib25 cDNA library is prepared from *Arabidopsis thaliana*, Columbia ecotype, open flower tissue. Wild type *Arabidopsis thaliana* seeds are planted in commonly used planting pots and grown in an environmental chamber. Flowers are completely opened with all parts of floral structure observable, but no siliques are appearing. The tissue was immediately frozen in liquid nitrogen and stored at −80' C. until total RNA extraction. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib35 cDNA library of the present invention, was prepared from *Arabidopsis thaliana* Columbia ecotype leaf tissue. Wild type *Arabidopsis thaliana* seeds are planted in commonly used planting pots and grown in an environmental chamber. After 5-6 weeks the plants are in the reproductive growth phase. Stems are bolting from the base of the plants. After 7 weeks, more stems and floral buds appeared and a few flowers were starting to open. Leaf blades were collected by cutting with sharp scissors. The tissues were immediately frozen in liquid nitrogen and stored at −80' C until use. PolyA mRNA is purified from the total RNA preparation using Dynabeads® Oligo(dT)$_{25}$ (Dynal Inc., Lake Success, N.Y.), or equivalent methods. This library was normalized using a PCR-based protocol.

The Lib146 cDNA library is prepared from *Arabidopsis thaliana*, Columbia ecotype, immature seed tissue. Wild type *Arabidopsis thaliana* seeds are planted in commonly used planting pots and grown in an environmental chamber. At approximately 7-8 weeks of age, the seeds are harvested. The seeds ranged in maturity from the smallest seeds that could be dissected from silques to just before starting to turn yellow in color. The tissue is immediately frozen in liquid nitrogen. The harvested tissue is stored at −80° C. until RNA extraction. PolyA mRNA is purified from the total RNA preparation using Dynabeads® Oligo(dT)$_{25}$ (Dynal Inc., Lake Success, N.Y.), or equivalent methods. This library is normalized using a PCR-based protocol.

The Lib3032 (Lib80) cDNA libraries are generated from *Brassica napus* seeds harvested 30 days after pollination. The cDNA libraries are constructed using the SuperScript Plasmid system for cDNA synthesis and plasmid cloning (Life Technologies, Gaithersgurg, Md. U.S.A.) according to the manufacturers protocol with the following modification: 40 micrograms of total RNA is used as the starting material for cDNA synthesis, and first strand cDNA synthesis is carried out at 45° C.

The Lib3034 (Lib82) cDNA libraries are generated from *Brassica napus* seeds harvested 15 and 18 days after pollination. The cDNA libraries are constructed using the SuperScript Plasmid system for cDNA synthesis and plasmid cloning (Life Technologies, Gaithersburg, Md. U.S.A.) according to the manufacturers protocol with the following modification: 40 micrograms of total RNA is used as the starting material for cDNA synthesis, and first strand cDNA synthesis was carried out at 45° C.

The Lib3099 cDNA library is generated by a subtraction procedure. The library contains cDNAs whose abundance is enriched in the *Brassica napus* 15 and 18 day after pollination seed tissues when compared to *Brassica* leaf tissues. The cDNA synthesis is performed on *Brassica* leaf RNA and *Brassica* RNA isolated from seeds harvested 15 and 18 days after pollination using a Smart PCR cDNA synthesis kit according to the manufacturers protocol (Clontech, Palo Alto, Calif. U.S.A.). The subtacted cDNA is generated using the Clontech PCR-Select subtaction kit according to the manufacturers protocol (Clontech, Palo Alto, Calif. U.S.A.). The subtacted cDNA was cloned into plasmid vector pCR2.1 according to the manufacturers protocol (Invitrogen, Carlsbad, Calif. U.S.A.).

The Lib3033 (Lib81) cDNA libraries are generated from from the *Schizochytrium* species cells. The *Schizochytrium* species cells are grown in liquid media until saturation. The culture is centrifuged to pellet the cells, the medium is decanted off, and pellet immediately frozen in liquid nitrogen. Wax esters are produced under such dark, anaerobic, rich-medium conditions. High wax production by the cultures is verified by microscopy (fluorescein staining of wax bodies) and by lipid extraction/TLC/GC. The harvested cells are stored at −80° C. until RNA preparation. RNA is prepared from the frozen *Euglena* cell pellet as follows. The pellet is pulverized to a powder in liquid nitrogen using a mortar and pestle. The powder is transferred to tubes containing 6 ml each of lysis buffer (100 mM Tris, pH 8, 0.6 M NaCl, 10 mM EDTA, and 4% (w/v) SDS) and buffered phenol, vortexed, and disrupted with a Polytron. The mixture is centrifuged 20 min at 10,000×g in Corex glass tubes to separate the phases. 5 ml of the upper phase is removed, vortexed with 5 ml fresh phenol, and centrifuged. The upper phase is removed and the RNA is precipitated overnight at 4° C. by adding 1.5 volumes of 4 M LiCl. The RNA is further purified on Rneasy columns according to the manufacturers protocol (Qiagen, Valencia, Calif. U.S.A.). The cDNA library is constructed using the SuperScript Plasmid system for cDNA synthesis and plasmid cloning (Life Technologies, Gaithersburg, Md. U.S.A.) according to the manufacturers protocol with the following modification: 40 micrograms of total RNA was used as the starting material for cDNA synthesis, and first strand cDNA synthesis was carried out at 45° C.

The Lib47 cDNA library is generated from *Euglena gracilus* strain 753 (ATTC No. 30285, ATCC Manasas, Va. U.S.A.) grown in liquid culture. A liquid culture is innoculated with 1/10 volume of a previously-grown saturated culture, and the new culture for 4 days under near-anaerobic conditions (near-anaerobic cultures are not agitated, just gently swirled once a day) in the dark in 2×Beef (10 g/l bacto peptone, 4 g/l yeast extract, 2 g/l beef extract, 6 g/l glucose). The culture is then centrifuged to pellet the cells, the medium is decanted off, and pellet immediately frozen in liquid nitrogen. Wax esters are produced under such dark, anaerobic, rich-medium conditions. High wax production by the cultures is verified by microscopy (fluorescein staining of wax bodies) and by lipid extraction/TLC/GC. The harvested cells are stored at −80° C. until RNA preparation. RNA is prepared from the frozen *Euglena* cell pellet as follows. The pellet is pulverized to a powder in liquid nitrogen using a mortar and pestle. The powder is transferred to tubes containing 6 ml each of lysis buffer (100 mM Tris, pH 8, 0.6 M NaCl, 10 mM EDTA, and 4% (w/v) SDS) and buffered phenol, vortexed, and disrupted with a Polytron. The mixture is centrifuged 20 min at 10,000×g in Corex glass tubes to separate the phases. 5 ml of the upper phase is removed, vortexed with 5 ml fresh phenol, and centrifuged. The upper phase is removed and the RNA is precipitated overnight at 4° C. by adding 1.5 volumes of 4 M LiCl. The RNA is further purified on Rneasy columns according to the manufacturers protocol (Qiagen, Valencia, Calif. U.S.A.). The cDNA library is constructed using the SuperScript Plasmid system for cDNA synthesis and plasmid cloning (Life Technologies, Gaithersburg, Md. U.S.A.) according to the manufacturers protocol with the following modification: 40 micrograms of total RNA was used as the starting material for cDNA synthesis, and first strand cDNA synthesis was carried out at 45° C.

The Lib44 cDNA library is generated from *Phaeodactylum tricornatum* grown in modified Jones medium for 3 days. The cells were harvested by centrifugation and the resulting pellet frozen immediately in liquid nitrogen. The harvested cells are stored at −80° C. until RNA preparation. RNA is prepared from the frozen *Phaeodactylum* cell pellet as follows. The pellet is pulverized to a powder in liquid nitrogen using a mortar and pestle. The powder is transferred to tubes containing 6 ml each of lysis buffer (100 mM Tris, pH 8, 0.6 M NaCl, 10 mM EDTA, and 4% (w/v) SDS) and buffered phenol, vortexed, and disrupted with a Polytron. The mixture is centrifuged 20 min at 10,000×g in Corex glass tubes to separate the phases. 5 ml of the upper phase is removed, vortexed with 5 ml fresh phenol, and centrifuged. The upper phase is removed and the RNA is precipitated overnight at 4° C. by adding 1.5 volumes of 4 M LiCl. The RNA is further purified on Rneasy columns according to the manufacturers protocol (Qiagen, Valencia, Calif. U.S.A.). The cDNA library is constructed using the SuperScript Plasmid system for cDNA synthesis and plasmid cloning (Life Technologies, Gaithersburg, Md. U.S.A.) according to the manufacturers protocol with the following modification: 40 micrograms of total RNA was used as the starting material for cDNA synthesis, and first strand cDNA synthesis was carried out at 45 degrees centigrade.

The LIB3036 genomic library is generated from *Mycobacterium neoaurum* US52 (ATCC No. 23072, ATCC, Manasas, Va. U.S.A.) cells. *Mycobacterium neoaurum* US52 is a gram-positive Actinomycete bacterium. *Mycobacterium neoaurum* US52 is genetically related to *Mycobacterium tuberculosis*, but there is no reason to believe that it is a primary pathogen. It normally is saprophytic, i.e. it lives in soil and gets nutrients from decaying matter. Genomic DNA obtained from *Mycobacterium neoaurum* US52 is digested for various times with the restriction enzyme Sau3A. The DNA fractions are size-separated on an agarose gel, and the first fraction wherein most of the partially-digested fragments are about 10 kB is used to isolated fragments in the range of 2-3 kB. For LIB3036, the 2-3 kB DNA is cloned into vector pRY401 (Invitrogen, Carlsbad, Calif. U.S.A.). The vector pZERO-2 (Invitrogen, Carlsbad, Calif. U.S.A.). is used for the construction of LIB3104.

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

Normalized libraries are made using essentially the Soares procedure (Soares et al., *Proc. Natl. Acad. Sci.* (U.S.A.) 91:9228-9232 (1994), the entirety of which is herein incorporated by reference). This approach is designed to reduce the initial 10,000-fold variation in individual cDNA frequencies to achieve abundances within one order of magnitude while maintaining the overall sequence complexity of the library. In the normalization process, the prevalence of high-abundance cDNA clones decreases dramatically, clones with mid-level abundance are relatively unaffected and clones for rare transcripts are effectively increased in abundance.

EXAMPLE 2

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

Template plasmid DNA clones are used for subsequent sequencing. For sequencing, the ABI PRISM dRhodamine Terminator Cycle Sequencing Ready Reaction Kit with AmpliTaq® DNA Polymerase, FS, is used (PE Applied Biosystems, Foster City, Calif. U.S.A.).

EXAMPLE 3

Nucleic acid sequences that encode for the following transcription factors: homeobox transcription factor, HLH transcription factor, leucine zipper transcription factor, zinc finger transcription factor and other transcription factors are identified from the Monsanto EST PhytoSeq database using TBLASTN (default values)(TBLASTN compares a protein query against the six reading frames of a nucleic acid sequence). Matches found with BLAST P values equal or less than 0.001 (probability) or BLAST Score of equal or greater than 90 are classified as hits. If the program used to determine the hit is HMMSW then the score refers to HMMSW score.

In addition, the GenBank database is searched with BLASTN and BLASTX (default values) using ESTs as queries. EST that pass the hit probability threshold of $10e^{-8}$ for the following enzymes are combined with the hits generated by using TBLASTN (described above) and classified by enzyme (see Table A below).

A cluster refers to a set of overlapping clones in the PhytoSeq database. Such an overlapping relationship among clones is designated as a "cluster" when BLAST scores from pairwise sequence comparisons of the member clones meets a predetermined minimum value or product score of 50 or more (Product Score=(BLAST SCORE×Percentage Identity)/(5×minimum [length (Seq1), length (Seq2)]))

Since clusters are formed on the basis of single-linkage relationships, it is possible for two non-overlapping clones to be members of the same cluster if, for instance, they both overlap a third clone with at least the predetermined minimum BLAST score (stringency). A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. Clones grouped in a cluster in most cases represent a contiguous sequence.

TABLE A*

*ARABIDOPSIS THALIANA* HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1 | 2951 | LIB24-017-Q1-E1-G11 | LIB24 | g642128 | BLASTN | 1335 | 1e-102 | 100 |
| 2 | 4472 | LIB25-100-Q1-E1-G12 | LIB25 | g402590 | BLASTN | 91 | 1e-17 | 30 |
| 3 | 4556 | LIB24-029-Q1-E1-F4 | LIB24 | g2506030 | BLASTN | 1992 | 1e-157 | 99 |
| 4 | 4592 | LIB24-009-Q1-E1-E10 | LIB24 | g3096930 | BLASTN | 77 | 1e-19 | 43 |
| 5 | 4649 | LIB23-054-Q1-E1-D8 | LIB23 | g527628 | BLASTN | 1035 | 1e-77 | 100 |
| 6 | 5149 | LIB24-096-Q1-E1-C8 | LIB24 | g1045043 | BLASTN | 2036 | 1e-161 | 99 |
| 7 | 5149 | LIB35-035-Q1-E1-B8 | LIB35 | g1045043 | BLASTN | 1825 | 1e-143 | 100 |
| 8 | 5730 | LIB146-010-Q1-E1-F5 | LIB146 | g1814423 | BLASTN | 1928 | 1e-151 | 99 |
| 9 | 5730 | LIB25-074-Q1-E1-F8 | LIB25 | g1814423 | BLASTN | 2014 | 1e-158 | 99 |
| 10 | 6090 | LIB22-076-Q1-E1-D3 | LIB22 | g527628 | BLASTN | 1885 | 1e-148 | 97 |
| 11 | 6090 | LIB22-062-Q1-E1-G5 | LIB22 | g527628 | BLASTN | 2025 | 1e-160 | 100 |
| 12 | 6090 | LIB22-025-Q1-E1-F10 | LIB22 | g527628 | BLASTN | 1836 | 1e-144 | 99 |
| 13 | 6663 | LIB24-122-Q1-E1-E1 | LIB24 | g166607 | BLASTN | 1936 | 1e-155 | 99 |
| 14 | 6663 | LIB24-123-Q1-E1-B8 | LIB24 | g166607 | BLASTN | 2116 | 1e-170 | 99 |
| 15 | 6663 | LIB25-104-Q1-E1-B12 | LIB25 | g166607 | BLASTN | 1791 | 1e-141 | 99 |
| 16 | 6663 | LIB25-088-Q1-E1-C12 | LIB25 | g166607 | BLASTN | 1971 | 1e-158 | 99 |
| 17 | 6965 | LIB24-029-Q1-E1-B8 | LIB24 | g499163 | BLASTN | 1620 | 1e-126 | 100 |
| 18 | 6965 | LIB25-067-Q1-E1-A5 | LIB25 | g499163 | BLASTN | 1828 | 1e-144 | 99 |
| 19 | 6965 | LIB25-087-Q1-E1-A9 | LIB25 | g499163 | BLASTN | 945 | 1e-70 | 100 |
| 20 | 6965 | LIB35-010-Q1-E1-H6 | LIB35 | g499163 | BLASTN | 1855 | 1e-146 | 100 |
| 21 | 7845 | LIB24-015-Q1-E1-G5 | LIB24 | g16161 | BLASTN | 1965 | 1e-157 | 98 |
| 22 | 8076 | ARABL1-023-Q1-B1-H6 | LIB9 | g166751 | BLASTN | 1514 | 1e-117 | 91 |
| 23 | 8318 | LIB23-061-Q1-E1-D11 | LIB23 | g499159 | BLASTN | 1720 | 1e-134 | 100 |
| 24 | 8318 | LIB24-058-Q1-E1-F6 | LIB24 | g499159 | BLASTN | 1776 | 1e-139 | 99 |
| 25 | 8318 | LIB24-070-Q1-E1-E7 | LIB24 | g499159 | BLASTN | 1851 | 1e-145 | 98 |
| 26 | 8318 | LIB25-101-Q1-E1-H2 | LIB25 | g499159 | BLASTN | 1696 | 1e-132 | 99 |
| 27 | 8352 | LIB22-060-Q1-E1-C4 | LIB22 | g499162 | BLASTN | 63 | 1e-17 | 57 |
| 28 | 8352 | LIB23-010-Q1-E1-H5 | LIB23 | g499162 | BLASTN | 64 | 1e-19 | 52 |
| 29 | 8782 | ARABL1-029-Q1-B1-H4 | LIB9 | g499161 | BLASTN | 1542 | 1e-119 | 97 |
| 30 | 8782 | ARABL1-025-Q1-B1-B5 | LIB9 | g499161 | BLASTN | 1532 | 1e-119 | 94 |
| 31 | 8782 | LIB23-023-Q1-E1-B6 | LIB23 | g499161 | BLASTN | 1740 | 1e-147 | 98 |
| 32 | 8782 | LIB23-057-Q1-E1-D3 | LIB23 | g499161 | BLASTN | 1673 | 1e-130 | 99 |
| 33 | 8782 | LIB23-074-Q1-E1-E7 | LIB23 | g499161 | BLASTN | 1781 | 1e-139 | 99 |
| 34 | 8782 | LIB24-133-Q1-E1-B2 | LIB24 | g499161 | BLASTN | 1594 | 1e-124 | 98 |
| 35 | 8782 | LIB25-019-Q1-E1-G7 | LIB25 | g499161 | BLASTN | 1916 | 1e-151 | 99 |
| 36 | 8782 | LIB25-110-Q1-E1-B 12 | LIB25 | g499161 | BLASTN | 1584 | 1e-123 | 96 |
| 37 | 8810 | LIB22-038-Q1-E1-F9 | LIB22 | g16327 | BLASTN | 1865 | 1e-146 | 100 |

TABLE A*-continued

ARABIDOPSIS THALIANA HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 38 | 8810 | LIB25-045-Q1-E1-F7 | LIB25 | g16327 | BLASTN | 1951 | 1e−158 | 97 |
| 39 | 8810 | LIB35-012-Q1-E1-F11 | LIB35 | g16327 | BLASTN | 1863 | 1e−146 | 98 |
| 40 | 8810 | LIB35-006-Q1-E1-C12 | LIB35 | g16327 | BLASTN | 948 | 1e−140 | 99 |
| 41 | 9334 | ARABL1-032-Q1-E1-C4 | LIB9 | g527636 | BLASTN | 367 | 1e−19 | 97 |
| 42 | 9433 | LIB23-030-Q1-E1-C10 | LIB23 | g499161 | BLASTN | 1099 | 1e−82 | 94 |
| 43 | 9433 | LIB35-024-Q1-E1-H6 | LIB35 | g499161 | BLASTN | 2130 | 1e−169 | 100 |
| 44 | 9433 | LIB35-031-Q1-E1-D9 | LIB35 | g499161 | BLASTN | 1836 | 1e−144 | 98 |
| 45 | 9433 | LIB35-002-Q1-E1-D7 | LIB35 | g499161 | BLASTN | 1229 | 1e−119 | 89 |
| 46 | 9454 | LIB35-023-Q1-E1-F1 | LIB35 | g3153206 | BLASTN | 1582 | 1e−153 | 97 |
| 47 | 9454 | LIB35-011-Q1-E1-H5 | LIB35 | g3153206 | BLASTN | 1665 | 1e−130 | 90 |
| 48 | 9542 | LIB23-045-Q1-E1-B9 | LIB23 | g1045041 | BLASTN | 730 | 1e−57 | 99 |
| 49 | 9542 | LIB35-047-Q1-E1-D3 | LIB35 | g1045041 | BLASTN | 1593 | 1e−123 | 92 |

ARABIDOPSIS THALIANA HLH TRANSCRIPTION FACTORS

| Seq No. | Cluster ID | CloneID | Library | NCBI gi | METHOD | Score | P-Value | % Ident |
|---|---|---|---|---|---|---|---|---|
| 50 | 1965 | LIB23-023-Q1-E1-E6 | LIB23 | g1465367 | BLASTN | 1320 | 1e−168 | 98 |
| 51 | 219 | LIB24-004-Q1-E1-F9 | LIB24 | g3193326 | BLASTN | 134 | 1e−20 | 69 |
| 52 | 2673 | LIB22-019-Q1-E1-D8 | LIB22 | g1465367 | BLASTN | 1970 | 1e−157 | 97 |
| 53 | 2673 | LIB25-058-P1-E1-A2 | LIB25 | g1465367 | BLASTN | 2026 | 1e−159 | 99 |
| 54 | 3920 | LIB24-021-Q1-E1-H4 | LIB24 | g1154626 | BLASTN | 2032 | 1e−160 | 99 |
| 55 | 5164 | LIB25-040-Q1-E1-D6 | LIB25 | g1154626 | BLASTN | 2032 | 1e−160 | 98 |
| 56 | 6525 | LIB24-060-Q1-E1-H4 | LIB24 | g1465367 | BLASTN | 1864 | 1e−146 | 99 |
| 57 | 6694 | LIB22-036-Q1-E1-C10 | LIB22 | g1465367 | BLASTN | 792 | 1e−57 | 95 |
| 58 | 7297 | LIB23-043-Q1-E1-H6 | LIB23 | g1465367 | BLASTN | 1766 | 1e−138 | 98 |
| 59 | 7297 | LIB25-086-Q1-E1-D5 | LIB25 | g1465367 | BLASTN | 1032 | 1e−77 | 99 |
| 60 | 7297 | LIB25-097-Q1-E1-H11 | LIB25 | g1465367 | BLASTN | 1001 | 1e−74 | 99 |
| 61 | 8183 | ARABL1-024-Q1-B1-C9 | LIB9 | g3036810 | BLASTN | 213 | 1e−31 | 51 |
| 62 | 8183 | LIB22-082-Q1-E2-A1 | LIB22 | g3036810 | BLASTN | 247 | 1e−36 | 55 |
| 63 | 8183 | LIB24-034-Q1-E1-A7 | LIB24 | g3036810 | BLASTN | 257 | 1e−37 | 55 |
| 64 | 8539 | LIB35-055-Q1-E1-B3 | LIB35 | g1154626 | BLASTN | 1533 | 1e−118 | 99 |
| 65 | 8539 | LIB35-055-Q1-E2-B3 | LIB35 | g1154626 | BLASTN | 2085 | 1e−164 | 100 |

*ARABIDOPSIS THALIANA* LEUCINE ZIPPER TRANSCRIPTION FACTORS

| Seq No. | Cluster ID | CloneID | Library | NCBI gi | METHOD | Score | P-Value | % Ident |
|---|---|---|---|---|---|---|---|---|
| 66 | 2474 | LIB25-040-Q1-E1-E1 | LIB25 | g1806260 | BLASTN | 463 | 1e−27 | 70 |
| 67 | 4341 | LIB25-074-Q1-E1-H2 | LIB25 | g1865678 | BLASTN | 295 | 1e−13 | 73 |
| 68 | 4559 | LIB22-065-Q1-E1-C5 | LIB22 | g19274 | BLASTN | 340 | 1e−38 | 65 |
| 69 | 4559 | LIB25-040-Q1-E1-F10 | LIB25 | g19274 | BLASTN | 277 | 1e−11 | 67 |
| 70 | 5743 | LIB22-058-Q1-E1-C10 | LIB22 | g3297824 | BLASTN | 121 | 1e−25 | 64 |
| 71 | 5743 | LIB24-131-Q1-E1-G1 | LIB24 | g3297824 | BLASTN | 121 | 1e−25 | 64 |
| 72 | 6498 | LIB24-089-Q1-E1-D7 | LIB24 | g1806261 | BLASTN | 121 | 1e−28 | 50 |
| 73 | 6498 | LIB25-013-Q1-E1-H7 | LIB25 | g1806261 | BLASTN | 81 | 1e−19 | 66 |
| 74 | 8748 | LIB23-023-Q1-E1-A9 | LIB23 | g1865678 | BLASTN | 328 | 1e−16 | 75 |
| 75 | 8748 | LIB24-045-Q1-E1-E7 | LIB24 | g1865678 | BLASTN | 328 | 1e−16 | 75 |
| 76 | 8748 | LIB35-027-Q1-E1-H9 | LIB35 | g1769890 | BLASTN | 452 | 1e−26 | 70 |
| 77 | 897 | LIB25-025-Q1-E1-A12 | LIB25 | g19275 | BLASTN | 114 | 1e−35 | 48 |
| 78 | 9263 | ARABLI-14-Q1-B1-A5 | LIB9 | g1033194 | BLASTN | 1728 | 1e−135 | 97 |
| 79 | 9263 | ARABL1-024-Q1-B1-A8 | LIB9 | g1033194 | BLASTN | 2015 | 1e−159 | 99 |
| 80 | 9263 | LIB23-037-Q1-E1-H10 | LIB23 | g1033194 | BLASTN | 1331 | 1e−102 | 99 |
| 81 | 9263 | LIB23-014-Q1-E1-A6 | LIB23 | g1033194 | BLASTN | 1747 | 1e−137 | 98 |
| 82 | 9263 | LIB23-035-Q1-E112-F8 | LIB23 | g1033194 | BLASTN | 1882 | 1e−148 | 99 |
| 83 | 9263 | LIB24-137-Q1-E1-G11 | LIB24 | g1033194 | BLASTN | 1752 | 1e−137 | 99 |
| 84 | 9263 | LIB25-024-Q1-E1-B1 | LIB25 | g1033194 | BLASTN | 1531 | 1e−118 | 99 |
| 85 | 9263 | LIB25-112-Q1-E1-E7 | LIB25 | g1033194 | BLASTN | 963 | 1e−71 | 96 |
| 86 | 9263 | LIB25-039-Q1-E1-D6 | LIB25 | g1033194 | BLASTN | 2211 | 1e−176 | 99 |
| 87 | 9263 | LIB25-091-Q1-E1-G10 | LIB25 | g1033194 | BLASTN | 1911 | 1e−150 | 99 |
| 88 | 9263 | LIB25-031-Q1-E1-D12 | LIB25 | g1033194 | BLASTN | 2016 | 1e−159 | 99 |
| 89 | 9263 | LIB25-098-Q1-E1-F9 | LIB25 | g1033194 | BLASTN | 1891 | 1e−149 | 99 |
| 46 | 9454 | LIB35-023-Q1-E1-F1 | LIB35 | g3153206 | BLASTN | 1582 | 1e−153 | 97 |
| 47 | 9454 | LIB35-011-Q1-E1-H5 | LIB35 | g3153206 | BLASTN | 1665 | 1e−130 | 90 |
| 90 | 9532 | LIB35-023-Q1-E1-F11 | LIB35 | g403417 | BLASTN | 1458 | 1e−113 | 98 |
| 91 | 9532 | LIB35-021-Q1-E1-D9 | LIB35 | g403417 | BLASTN | 1766 | 1e−141 | 99 |
| 92 | 959 | LIB25-039-Q1-E1-D12 | LIB25 | g1865678 | BLASTN | 2196 | 1e−176 | 96 |
| 93 | 994 | LIB146-009-Q1-E1-A1 | LIB146 | g3297824 | BLASTN | 99 | 1e−26 | 68 |

ARABIDOPSIS THALIANA ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 94 | 1456 | LIB35-026-Q1-E1-H4 | LIB35 | g1359492 | BLASTN | 705 | 1e−49 | 100 |
| 95 | 2391 | LIB25-086-Q1-E1-F5 | LIB25 | g1418334 | BLASTN | 917 | 1e−67 | 98 |
| 96 | 2609 | LIB146-013-Q1-E1-D8 | LIB146 | g2961541 | BLASTN | 1975 | 1e−158 | 100 |
| 97 | 2609 | LIB146-008-Q1-E1-B9 | LIB146 | g2961541 | BLASTN | 1279 | 1e−98 | 90 |
| 98 | 2752 | LIB22-068-Q1-E1-C6 | LIB22 | g1359492 | BLASTN | 327 | 1e−16 | 70 |
| 99 | 2929 | LIB24-026-Q1-E1-H7 | LIB24 | g340456 | BLASTN | 87 | 1e−22 | 43 |
| 100 | 4393 | LIB24-095-Q1-E1-C8 | LIB24 | g2582642 | BLASTN | 1850 | 1e−148 | 100 |
| 101 | 4451 | LIB25-016-Q1-E1-E12 | LIB25 | g1800278 | BLASTN | 2020 | 1e−159 | 98 |
| 102 | 4451 | LIB25-007-Q1-E1-F1 | LIB25 | g1800278 | BLASTN | 1601 | 1e−124 | 95 |
| 103 | 4510 | ARABL1-025-Q1-B1-G9 | LIB9 | g790686 | BLASTN | 482 | 1e−31 | 98 |
| 104 | 5651 | LIB23-060-Q1-E1-A4 | LIB23 | g1773039 | BLASTN | 269 | 1e−11 | 72 |
| 105 | 5651 | LIB23-045-Q1-E1-C6 | LIB23 | g1773039 | BLASTN | 266 | 1e−11 | 74 |
| 106 | 5651 | LIB24-014-Q1-E1-G10 | LIB24 | g1773039 | BLASTN | 260 | 1e−10 | 71 |
| 107 | 6087 | LIB146-012-Q1-E1-G4 | LIB146 | g2511546 | BLASTN | 86 | 1e−18 | 53 |
| 108 | 6653 | LIB22-014-Q1-E1-D6 | LIB22 | g1360087 | BLASTN | 501 | 1e−31 | 77 |
| 109 | 6653 | LIB23-039-Q1-E1-D4 | LIB23 | g1360088 | BLASTN | 166 | 1e−26 | 90 |
| 110 | 6653 | LIB25-112-Q1-E1-C8 | LIB25 | g1359492 | BLASTN | 496 | 1e−30 | 78 |
| 111 | 7386 | LIB22-011-Q1-K1-E4 | LIB22 | g1871192 | BLASTN | 212 | 1e−33 | 47 |
| 112 | 7386 | LIB22-085-Q1-E2-B1 | LIB22 | g1871192 | BLASTN | 119 | 1e−21 | 53 |
| 113 | 7386 | LIB22-058-Q1-E1-B11 | LIB22 | g1871192 | BLASTN | 132 | 1e−23 | 51 |
| 114 | 7386 | LIB22-001-Q1-E1-B5 | LIB22 | g1871192 | BLASTN | 135 | 1e−23 | 51 |
| 115 | 7551 | LIB25-068-Q1-E1-B4 | LIB25 | g1872520 | BLASTN | 1056 | 1e−135 | 99 |
| 116 | 7827 | LIB23-057-Q1-E1-E6 | LIB23 | g2340087 | BLASTN | 1559 | 1e−121 | 98 |
| 117 | 8238 | LIB22-004-Q1-E1-G7 | LIB22 | g1360087 | BLASTN | 422 | 1e−24 | 72 |
| 118 | 8238 | LIB25-078-Q1-E1-G1 | LIB25 | g1360086 | BLASTN | 130 | 1e−20 | 79 |
| 119 | 8287 | ARABL1-019-Q1-B1-G1 | LIB9 | g1800278 | BLASTN | 343 | 1e−22 | 74 |
| 120 | 8287 | ARABL1-025-Q1-B1-C6 | LIB9 | g1800278 | BLASTN | 343 | 1e−22 | 76 |
| 121 | 8287 | LIB22-067-Q1-E1-H9 | LIB22 | g1800278 | BLASTN | 336 | 1e−16 | 75 |
| 122 | 8287 | LIB25-007-Q1-E1-G11 | LIB25 | g1800278 | BLASTN | 336 | 1e−23 | 77 |
| 123 | 8287 | LIB35-002-Q1-E1-H6 | LIB35 | g1800278 | BLASTN | 699 | 1e−58 | 78 |
| 124 | 8469 | LIB25-006-Q1-E2-A7 | LIB25 | g1182006 | BLASTN | 736 | 1e−53 | 78 |
| 125 | 8479 | LIB24-136-Q1-E1-G9 | LIB24 | g2582644 | BLASTN | 2042 | 1e−163 | 99 |
| 126 | 8479 | LIB25-066-Q1-E1-C10 | LIB25 | g2582644 | BLASTN | 1958 | 1e−156 | 99 |
| 127 | 8479 | LIB35-042-Q1-E1-H4 | LIB35 | g2582644 | BLASTN | 1729 | 1e−137 | 98 |
| 128 | 849 | LIB35-005-Q1-E1-A1 | LIB35 | g2780365 | BLASTN | 165 | 1e−35 | 51 |
| 129 | 849 | LIB35-043-Q1-E1-A2 | LIB35 | g2780365 | BLASTN | 165 | 1e−35 | 51 |
| 130 | 8725 | LIB22-051-Q1-E1-D4 | LIB22 | g2961541 | BLASTN | 404 | 1e−22 | 60 |

ARABIDOPSIS THALIANA ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 131 | 8725 | LIB22-078-Q1-E1-H1 | LIB22 | g1800278 | BLASTN | 452 | 1e−33 | 66 |
| 132 | 8725 | LIB22-075-Q1-E1-D4 | LIB22 | g1871192 | BLASTN | 223 | 1e−32 | 41 |
| 133 | 8725 | LIB22-034-Q1-E2-G1 | LIB22 | g1871192 | BLASTN | 264 | 1e−38 | 55 |
| 134 | 8725 | LIB23-051-Q1-E1-E12 | LIB23 | g1871192 | BLASTN | 151 | 1e−27 | 49 |
| 135 | 8744 | ARABL1-031-Q1-B1-G12 | LIB9 | g1565226 | BLASTN | 645 | 1e−45 | 96 |
| 136 | 8744 | LIB22-078-Q1-E1-F9 | LIB22 | g1418322 | BLASTN | 2102 | 1e−167 | 99 |
| 137 | 8744 | LIB22-068-Q1-E1-A4 | LIB22 | g1418322 | BLASTN | 2000 | 1e−158 | 98 |
| 138 | 8744 | LIB22-056-Q1-E1-E11 | LIB22 | g1565226 | BLASTN | 1818 | 1e−145 | 99 |
| 139 | 8744 | LIB25-104-Q1-E1-D7 | LIB25 | g1565226 | BLASTN | 1710 | 1e−135 | 100 |
| 140 | 8744 | LIB35-015-Q1-E1-H12 | LIB35 | g1418322 | BLASTN | 743 | 1e−55 | 97 |
| 141 | 8794 | LIB24-135-Q1-E1-A6 | LIB24 | g2801793 | BLASTN | 113 | 1e−18 | 50 |
| 142 | 9044 | LIB22-023-Q1-E1-G11 | LIB22 | g1800278 | BLASTN | 1721 | 1e−159 | 98 |
| 143 | 9044 | LIB23-043-Q1-E1-F1 | LIB23 | g1800278 | BLASTN | 1721 | 1e−158 | 98 |
| 144 | 9044 | LIB23-035-Q1-E112-G6 | LIB23 | g1800278 | BLASTN | 1721 | 1e−147 | 98 |
| 145 | 9044 | LIB24-059-Q1-E1-D4 | LIB24 | g1800278 | BLASTN | 1649 | 1e−131 | 97 |
| 146 | 9044 | LIB24-124-Q1-E1-A2 | LIB24 | g1800278 | BLASTN | 1649 | 1e−150 | 96 |
| 147 | 9044 | LIB24-126-Q1-E1-G8 | LIB24 | g1800278 | BLASTN | 1712 | 1e−149 | 98 |
| 148 | 9044 | LIB24-124-Q1-E2-A2 | LIB24 | g1800278 | BLASTN | 1667 | 1e−132 | 96 |

ARABIDOPSIS THALIANA OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 149 | 1486 | LIB22-056-Q1-E1-H3 | LIB22 | g2564336 | BLASTN | 1769 | 1e−138 | 92 |
| 150 | 162 | LIB24-090-Q1-E1-F7 | LIB24 | g2961084 | BLASTN | 2170 | 1e−171 | 100 |
| 151 | 1625 | LIB23-065-Q1-E1-G1 | LIB23 | g2555018 | BLASTN | 83 | 1e−17 | 38 |
| 152 | 1979 | LIB24-112-Q1-E1-F3 | LIB24 | g2398524 | BLASTN | 406 | 1e−22 | 69 |
| 153 | 1996 | LIB25-073-Q1-E1-E3 | LIB25 | g19259 | BLASTN | 574 | 1e−36 | 77 |
| 154 | 2289 | LIB146-012-Q1-E1-C11 | LIB146 | g3399764 | BLASTN | 600 | 1e−39 | 72 |
| 155 | 236 | LIB23-013-Q1-E1-F1 | LIB23 | g2765441 | BLASTN | 1336 | 1e−145 | 95 |
| 156 | 236 | LIB25-077-Q1-E1-E11 | LIB25 | g2765441 | BLASTN | 1761 | 1e−157 | 95 |
| 157 | 2370 | LIB146-026-Q1-K1-G11 | LIB146 | g16545 | BLASTN | 1055 | 1e−125 | 93 |
| 158 | 2476 | LIB22-087-Q1-E1-E2 | LIB22 | g2196466 | BLASTN | 217 | 1e−56 | 61 |
| 159 | 2476 | LIB25-002-Q1-E1-A8 | LIB25 | g2196466 | BLASTN | 218 | 1e−55 | 62 |
| 160 | 2700 | LIB22-087-Q1-E1-D10 | LIB22 | g2832403 | BLASTN | 1734 | 1e−136 | 98 |
| 161 | 2700 | LIB23-069-Q1-E1-F11 | LIB23 | g2832403 | BLASTN | 1481 | 1e−114 | 99 |

-continued

ARABIDOPSIS THALIANA OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 162 | 2758 | LIB22-047-Q1-E1-C3 | LIB22 | g1747309 | BLASTN | 1712 | 1e-136 | 99 |
| 163 | 2758 | LIB22-031-Q1-E1-C7 | LIB22 | g1747309 | BLASTN | 1392 | 1e-107 | 99 |
| 164 | 2772 | LIB22-033-Q1-E2-G2 | LIB22 | g1183866 | BLASTN | 174 | 1e-28 | 62 |
| 165 | 2772 | LIB22-033-Q1-E1-G2 | LIB22 | g1183864 | BLASTN | 112 | 1e-17 | 45 |
| 166 | 2824 | LIB22-031-Q1-E1-H8 | LIB22 | g2832407 | BLASTN | 923 | 1e-68 | 75 |
| 167 | 2881 | LIB24-118-Q1-E1-B3 | LIB24 | g2959733 | BLASTN | 1732 | 1e-138 | 99 |
| 168 | 2929 | LIB22-059-Q1-E1-C11 | LIB22 | g64475 | BLASTN | 67 | 1e-18 | 46 |
| 169 | 3322 | LIB22-056-Q1-E1-G12 | LIB22 | g2398522 | BLASTN | 1538 | 1e-119 | 99 |
| 170 | 3322 | LIB22-014-Q1-E1-E7 | LIB22 | g2398522 | BLASTN | 1724 | 1e-135 | 98 |
| 171 | 3596 | LIB24-070-Q1-E1-E8 | LIB24 | g2959735 | BLASTN | 2033 | 1e-163 | 99 |
| 172 | 3605 | LIB22-055-Q1-E1-D6 | LIB22 | g786425 | BLASTN | 271 | 1e-17 | 71 |
| 173 | 3808 | ARABL1-01-Q1-E1-E12 | LIB9 | g1263094 | BLASTN | 1917 | 1e-151 | 99 |
| 174 | 4015 | LIB22-020-Q1-E1-E8 | LIB22 | g20562 | BLASTN | 664 | 1e-45 | 71 |
| 175 | 4127 | LIB22-031-Q1-E1-A4 | LIB22 | g2826883 | BLASTN | 1880 | 1e-148 | 90 |
| 176 | 4333 | LIB22-032-Q1-E1-B8 | LIB22 | g2145357 | BLASTN | 2073 | 1e-163 | 99 |
| 177 | 4333 | LIB22-041-Q1-E1-F7 | LIB22 | g2145357 | BLASTN | 2098 | 1e-165 | 99 |
| 178 | 4333 | LIB22-086-Q1-E1-F5 | LIB22 | g2145357 | BLASTN | 1930 | 1e-157 | 98 |
| 179 | 4522 | LIB23-040-Q1-E1-E7 | LIB23 | g3329392 | BLASTN | 151 | 1e-21 | 41 |
| 180 | 4522 | LIB25-083-Q1-E1-D11 | LIB25 | g3329392 | BLASTN | 170 | 1e-25 | 41 |
| 181 | 4681 | LIB22-013-Q1-E1-A1 | LIB22 | g2398524 | BLASTN | 1630 | 1e-127 | 100 |
| 182 | 4681 | LIB22-015-Q1-E1-A11 | LIB22 | g2398524 | BLASTN | 2047 | 1e-162 | 99 |
| 183 | 4681 | LIB24-123-Q1-E1-A1 | LIB24 | g2398524 | BLASTN | 2135 | 1e-169 | 98 |
| 184 | 5098 | LIB22-088-Q1-E1-F11 | LIB22 | g2959731 | BLASTN | 1885 | 1e-149 | 100 |
| 185 | 5133 | LIB23-048-Q1-E1-H10 | LIB23 | g1666172 | BLASTN | 908 | 1e-67 | 79 |
| 186 | 5133 | LIB25-114-Q1-E1-A6 | LIB25 | g1666172 | BLASTN | 785 | 1e-56 | 75 |
| 187 | 5347 | LIB22-044-Q1-E1-E12 | LIB22 | g2245393 | BLASTN | 2053 | 1e-162 | 99 |
| 188 | 5347 | LIB23-017-Q1-E1-E6 | LIB23 | g2245393 | BLASTN | 1538 | 1e-119 | 92 |
| 189 | 5347 | LIB24-093-Q1-E1-A12 | LIB24 | g2245393 | BLASTN | 2016 | 1e-159 | 98 |
| 190 | 537 | LIB35-005-Q1-E1-F1 | LIB35 | g2398532 | BLASTN | 427 | 1e-24 | 72 |
| 191 | 537 | LIB35-045-Q1-E1-B6 | LIB35 | g2398532 | BLASTN | 334 | 1e-16 | 73 |
| 192 | 5417 | LIB23-035-Q1-E1-H11 | LIB23 | g3399764 | BLASTN | 326 | 1e-15 | 82 |
| 193 | 5417 | LIB24-132-Q1-E1-A7 | LIB24 | g3399764 | BLASTN | 400 | 1e-22 | 80 |
| 194 | 5515 | LIB25-046-Q1-E1-D6 | LIB25 | g2252479 | BLASTN | 333 | 1e-16 | 94 |
| 195 | 5599 | LIB23-022-Q2-E1-E4 | LIB23 | g1514441 | BLASTN | 283 | 1e-12 | 65 |
| 196 | 5599 | LIB23-039-Q1-E1-F7 | LIB23 | g1514441 | BLASTN | 519 | 1e-32 | 67 |
| 197 | 5721 | LIB22-075-Q1-E1-G6 | LIB22 | g304112 | BLASTN | 329 | 1e-16 | 73 |
| 198 | 5913 | LIB25-037-Q1-E1-C5 | LIB25 | g1429225 | BLASTN | 1733 | 1e-135 | 99 |

ARABIDOPSIS THALIANA OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 199 | 6004 | LIB22-063-Q1-E1-H9 | LIB22 | g3183616 | BLASTN | 672 | 1e-45 | 74 |
| 200 | 6004 | LIB24-115-Q1-E1-B2 | LIB24 | g3183616 | BLASTN | 674 | 1e-46 | 75 |
| 201 | 6004 | LIB24-087-Q1-E1-A8 | LIB24 | g3183616 | BLASTN | 946 | 1e-70 | 75 |
| 202 | 6171 | ARABLI-14-Q1-B1-A11 | LIB9 | g2832405 | BLASTN | 780 | 1e-56 | 78 |
| 203 | 6171 | LIB22-038-Q1-E1-A1 | LIB22 | g2832405 | BLASTN | 920 | 1e-67 | 78 |
| 204 | 6171 | LIB24-136-Q1-E1-B11 | LIB24 | g2832405 | BLASTN | 317 | 1e-15 | 81 |
| 205 | 6171 | LIB35-043-Q1-E1-H9 | LIB35 | g2832405 | BLASTN | 777 | 1e-55 | 77 |
| 206 | 6246 | LIB22-055-Q1-E1-F7 | LIB22 | g2245393 | BLASTN | 1969 | 1e-155 | 97 |
| 207 | 6246 | LIB24-010-Q1-E1-C8 | LIB24 | g2245393 | BLASTN | 1887 | 1e-161 | 98 |
| 208 | 6276 | ARABLI-12-Q1-B1-C2 | LIB9 | g1850792 | BLASTN | 793 | 1e-127 | 98 |
| 209 | 6397 | ARABL1-031-Q1-B1-E8 | LIB9 | g2398530 | BLASTN | 841 | 1e-99 | 83 |
| 210 | 6602 | LIB146-026-Q1-K1-B5 | LIB146 | g16428 | BLASTN | 1154 | 1e-159 | 97 |
| 211 | 6602 | LIB24-012-Q1-E1-G11 | LIB24 | g16428 | BLASTN | 2106 | 1e-166 | 99 |
| 212 | 6653 | LIB24-001-Q1-E1-D10 | LIB24 | g2920707 | BLASTN | 513 | 1e-33 | 78 |
| 213 | 6801 | LIB22-056-Q1-E1-G9 | LIB22 | g945084 | BLASTN | 1000 | 1e-74 | 100 |
| 214 | 6801 | LIB24-062-Q1-E1-F9 | LIB24 | g945084 | BLASTN | 1196 | 1e-91 | 99 |
| 215 | 6801 | LIB25-056-Q1-E1-B4 | LIB25 | g945084 | BLASTN | 1186 | 1e-90 | 99 |
| 216 | 6801 | LIB25-105-Q1-E1-C1 | LIB25 | g945084 | BLASTN | 1155 | 1e-87 | 100 |
| 217 | 7125 | LIB22-035-Q1-E1-D8 | LIB22 | g786425 | BLASTN | 365 | 1e-19 | 72 |
| 218 | 7125 | LIB24-060-Q1-E1-F5 | LIB24 | g786425 | BLASTN | 419 | 1e-44 | 77 |
| 219 | 7252 | LIB35-042-Q1-E1-B7 | LIB35 | g1747309 | BLASTN | 1151 | 1e-87 | 99 |
| 220 | 7274 | ARABL1-033-Q1-B1-A7 | LIB9 | g2826881 | BLASTN | 841 | 1e-77 | 96 |
| 221 | 7320 | LIB24-123-Q1-E2-A5 | LIB24 | g166587 | BLASTN | 1651 | 1e-130 | 99 |
| 222 | 7320 | LIB24-123-Q1-E1-A5 | LIB24 | g166587 | BLASTN | 1565 | 1e-122 | 100 |
| 223 | 7320 | LIB25-001-Q1-E2-G12 | LIB25 | g166595 | BLASTN | 2102 | 1e-169 | 99 |
| 224 | 7320 | LIB25-001-Q1-E1-G12 | LIB25 | g166595 | BLASTN | 2013 | 1e-161 | 99 |
| 225 | 7320 | LIB25-013-Q1-E1-E5 | LIB25 | g166587 | BLASTN | 1941 | 1e-155 | 98 |
| 226 | 7321 | LIB22-026-Q1-E1-B8 | LIB22 | g1890351 | BLASTN | 795 | 1e-57 | 84 |
| 227 | 7321 | LIB24-028-Q1-E1-A3 | LIB24 | g1890351 | BLASTN | 823 | 1e-94 | 82 |
| 228 | 7321 | LIB25-051-Q1-E1-D10 | LIB25 | g1890351 | BLASTN | 824 | 1e-106 | 83 |
| 229 | 7425 | LIB22-076-Q1-E1-B3 | LIB22 | g2832517 | BLASTN | 639 | 1e-44 | 97 |
| 230 | 7486 | LIB24-016-Q1-E1-A5 | LIB24 | g166592 | BLASTN | 2061 | 1e-163 | 99 |
| 231 | 7486 | LIB24-047-Q1-E1-A12 | LIB24 | g166589 | BLASTN | 1749 | 1e-137 | 98 |
| 232 | 7486 | LIB24-025-Q1-E1-C8 | LIB24 | g166592 | BLASTN | 2013 | 1e-159 | 97 |
| 233 | 7486 | LIB25-016-Q1-E1-F11 | LIB25 | g166589 | BLASTN | 2020 | 1e-159 | 100 |
| 234 | 7486 | LIB25-111-Q1-E1-C9 | LIB25 | g166589 | BLASTN | 1965 | 1e-155 | 100 |
| 235 | 7500 | LIB146-010-Q1-E1-F7 | LIB146 | g2959729 | BLASTN | 1365 | 1e-105 | 100 |

-continued

ARABIDOPSIS THALIANA OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 236 | 7500 | LIB22-043-Q1-E1-B12 | LIB22 | g2959729 | BLASTN | 2046 | 1e−162 | 99 |
| 237 | 7584 | LIB24-118-Q1-E1-C12 | LIB24 | g2462080 | BLASTN | 1354 | 1e−106 | 88 |
| 238 | 7584 | LIB24-058-Q1-E1-H3 | LIB24 | g2462080 | BLASTN | 1775 | 1e−141 | 100 |
| 239 | 7584 | LIB24-069-Q1-E1-F1 | LIB24 | g2462080 | BLASTN | 1980 | 1e−158 | 100 |
| 240 | 7584 | LIB24-132-Q1-E1-F9 | LIB24 | g2462080 | BLASTN | 2050 | 1e−164 | 100 |
| 241 | 7590 | LIB24-109-Q1-E1-H7 | LIB24 | g1666172 | BLASTN | 919 | 1e−68 | 74 |
| 242 | 7590 | LIB35-030-Q1-E1-C8 | LIB35 | g1666172 | BLASTN | 865 | 1e−63 | 73 |
| 243 | 7630 | LIB22-008-Q1-E1-F8 | LIB22 | g2398532 | BLASTN | 811 | 1e−59 | 79 |
| 244 | 7630 | LIB25-051-Q1-E1-D11 | LIB25 | g2398532 | BLASTN | 678 | 1e−46 | 77 |
| 245 | 7630 | LIB25-076-Q1-E1-D11 | LIB25 | g2398532 | BLASTN | 415 | 1e−23 | 80 |
| 246 | 7650 | LIB25-032-Q1-E1-E9 | LIB25 | g16547 | BLASTN | 1906 | 1e−150 | 91 |
| 247 | 7650 | LIB25-094-Q1-E1-H12 | LIB25 | g16545 | BLASTN | 985 | 1e−73 | 100 |
| 248 | 7819 | LIB22-080-Q1-E1-B2 | LIB22 | g3395937 | BLASTN | 1542 | 1e−119 | 99 |
| 249 | 7819 | LIB22-056-Q1-E1-F8 | LIB22 | g3395937 | BLASTN | 1735 | 1e−135 | 98 |
| 250 | 7819 | LIB22-080-Q1-E2-B2 | LIB22 | g3395937 | BLASTN | 1477 | 1e−114 | 99 |
| 251 | 7857 | LIB22-081-Q1-E2-A5 | LIB22 | g2564336 | BLASTN | 1465 | 1e−118 | 89 |
| 252 | 7857 | LIB22-017-Q1-E1-A6 | LIB22 | g2564336 | BLASTN | 1506 | 1e−121 | 89 |
| 253 | 7857 | LIB24-010-Q1-E1-H9 | LIB24 | g2564336 | BLASTN | 1233 | 1e−99 | 86 |
| 254 | 7857 | LIB25-111-Q1-E1-B3 | LIB25 | g2564336 | BLASTN | 1548 | 1e−125 | 88 |
| 255 | 7857 | LIB25-066-Q1-E1-C8 | LIB25 | g2564336 | BLASTN | 1475 | 1e−119 | 89 |
| 256 | 7857 | LIB25-115-Q1-E1-B9 | LIB25 | g2564336 | BLASTN | 1465 | 1e−117 | 89 |
| 257 | 7984 | LIB35-011-Q1-E1-A10 | LIB35 | g928968 | BLASTN | 368 | 1e−40 | 86 |
| 258 | 8232 | LIB22-028-Q1-E1-B4 | LIB22 | g2104680 | BLASTN | 341 | 1e−17 | 69 |
| 259 | 8629 | LIB22-035-Q1-E1-H7 | LIB22 | g2104680 | BLASTN | 248 | 1e−09 | 63 |
| 260 | 8629 | LIB23-013-Q1-E1-E9 | LIB23 | g2104680 | BLASTN | 262 | 1e−10 | 67 |
| 261 | 8629 | LIB24-048-Q1-E2-E6 | LIB24 | g2104680 | BLASTN | 253 | 1e−09 | 66 |
| 262 | 8629 | LIB24-048-Q1-E1-E6 | LIB24 | g2104680 | BLASTN | 244 | 1e−09 | 65 |
| 263 | 8728 | ARABL1-02-Q1-E1-G10 | LIB9 | g1173615 | BLASTN | 200 | 1e−09 | 84 |
| 264 | 8736 | LIB22-004-Q1-E1-C9 | LIB22 | g556558 | BLASTN | 415 | 1e−61 | 68 |
| 265 | 8736 | LIB22-064-Q1-E1-H5 | LIB22 | g556557 | BLASTN | 1097 | 1e−82 | 75 |
| 266 | 8736 | LIB22-022-Q1-E1-A3 | LIB22 | g556558 | BLASTN | 243 | 1e−37 | 70 |
| 267 | 8736 | LIB23-066-Q1-E1-D2 | LIB23 | g556558 | BLASTN | 327 | 1e−50 | 79 |
| 268 | 8736 | LIB23-001-Q1-E1-F11 | LIB23 | g556558 | BLASTN | 334 | 1e−50 | 78 |
| 269 | 8736 | LIB24-092-Q1-E1-B7 | LIB24 | g556557 | BLASTN | 694 | 1e−47 | 65 |
| 270 | 8773 | LIB22-035-Q1-E1-D10 | LIB22 | g1572786 | BLASTN | 86 | 1e−19 | 45 |
| 271 | 8873 | ARABL1-022-Q1-B1-H10 | LIB9 | g1263094 | BLASTN | 2026 | 1e−160 | 99 |
| 272 | 8873 | ARABL1-022-Q1-B1-D1 | LIB9 | g1263094 | BLASTN | 1978 | 1e−156 | 99 |

ARABIDOPSIS THALIANA OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 273 | 8873 | ARABL1-019-Q1-B1-G3 | LIB9 | g1263094 | BLASTN | 1816 | 1e-142 | 99 |
| 274 | 8873 | LIB22-088-Q1-E1-E11 | LIB22 | g1263094 | BLASTN | 1856 | 1e-146 | 99 |
| 275 | 8873 | LIB23-036-Q1-E1-C12 | LIB23 | g1263094 | BLASTN | 1892 | 1e-149 | 99 |
| 276 | 8873 | LIB24-090-Q1-E1-D12 | LIB24 | g1263094 | BLASTN | 2041 | 1e-162 | 99 |
| 277 | 8873 | LIB25-003-Q1-E1-H3 | LIB25 | g1263094 | BLASTN | 1867 | 1e-147 | 99 |
| 278 | 8873 | LIB25-114-Q1-E1-B5 | LIB25 | g1263094 | BLASTN | 1931 | 1e-152 | 99 |
| 279 | 8873 | LIB25-084-Q1-E1-E6 | LIB25 | g1263094 | BLASTN | 1080 | 1e-81 | 100 |
| 280 | 8919 | LIB22-079-Q1-E1-G7 | LIB22 | g2505876 | BLASTN | 302 | 1e-45 | 89 |
| 281 | 8919 | LIB24-031-Q1-E1-F8 | LIB24 | g2505876 | BLASTN | 291 | 1e-48 | 81 |
| 282 | 8993 | LIB146-015-Q1-E1-H7 | LIB146 | g1292897 | BLASTN | 406 | 1e-22 | 63 |
| 283 | 8994 | ARABL1-029-Q1-B1-C2 | LIB9 | g1890351 | BLASTN | 1316 | 1e-101 | 99 |
| 284 | 8994 | ARABLI-15-Q1-B1-H9 | LIB9 | g1890351 | BLASTN | 1318 | 1e-108 | 97 |
| 285 | 8994 | LIB22-047-Q1-E1-D5 | LIB22 | g1890351 | BLASTN | 1555 | 1e-125 | 100 |
| 286 | 8994 | LIB22-031-Q1-E1-F10 | LIB22 | g1890351 | BLASTN | 1245 | 1e-95 | 98 |
| 287 | 8994 | LIB24-077-Q1-E1-G6 | LIB24 | g1890351 | BLASTN | 1476 | 1e-114 | 93 |
| 288 | 8994 | LIB25-085-Q1-E1-B10 | LIB25 | g1890351 | BLASTN | 1461 | 1e-113 | 99 |
| 289 | 9030 | LIB23-072-Q1-E1-G1 | LIB23 | g290056 | BLASTN | 454 | 1e-26 | 68 |
| 290 | 9030 | LIB23-021-Q2-E1-C3 | LIB23 | g290056 | BLASTN | 472 | 1e-28 | 70 |
| 291 | 9106 | LIB24-122-Q1-E1-A6 | LIB24 | g2104680 | BLASTN | 232 | 1e-09 | 75 |
| 292 | 9106 | LIB24-136-Q1-E1-G12 | LIB24 | g2104680 | BLASTN | 420 | 1e-23 | 72 |
| 293 | 9106 | LIB25-044-Q1-E1-G7 | LIB25 | g2104680 | BLASTN | 232 | 1e-08 | 75 |
| 294 | 9532 | LIB24-073-Q1-E1-C2 | LIB24 | g3184053 | BLASTN | 361 | 1e-23 | 64 |
| 295 | 9532 | LIB25-027-Q1-E1-D7 | LIB25 | g1483229 | BLASTN | 422 | 1e-24 | 66 |
| 296 | 9532 | LIB35-004-Q1-E1-H9 | LIB35 | g1483229 | BLASTN | 413 | 1e-23 | 65 |
| 297 | 9532 | LIB35-043-Q1-E1-F9 | LIB35 | g939780 | BLASTN | 394 | 1e-21 | 68 |
| 298 | 9532 | LIB35-052-Q1-E1-D8 | LIB35 | g1483229 | BLASTN | 413 | 1e-23 | 65 |
| 299 | 9542 | LIB23-068-Q1-E1-H9 | LIB23 | g2735764 | BLASTN | 255 | 1e-52 | 58 |

MAIZE ZINC-FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 300 | -700016325 | 700016325H1 | SATMON001 | g2746333 | BLASTN | 162 | 1e-24 | 50 |
| 301 | -700026959 | 700026959H1 | SATMON003 | g2088668 | BLASTN | 181 | 1e-26 | 54 |
| 302 | -700027280 | 700027280H1 | SATMON003 | g441220 | BLASTN | 233 | 1e-26 | 79 |
| 303 | -700027480 | 700027480H1 | SATMON003 | g2746333 | BLASTN | 129 | 1e-21 | 66 |
| 304 | -700042789 | 700042789H1 | SATMON004 | g1872521 | BLASTN | 170 | 1e-36 | 64 |
| 305 | -700048422 | 700048422H1 | SATMON003 | g1871192 | BLASTN | 73 | 1e-18 | 69 |
| 306 | -700051791 | 700051791H1 | SATMON003 | g441220 | BLASTN | 238 | 1e-20 | 79 |
| 307 | -700075825 | 700075825H1 | SATMON007 | g790683 | BLASTN | 163 | 1e-24 | 90 |
| 308 | -700076194 | 700076194H1 | SATMON007 | g1321818 | BLASTN | 172 | 1e-25 | 50 |

-continued

MAIZE ZINC-FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 309 | -700083928 | 700083928H1 | SATMON011 | g1517914 | BLASTN | 111 | 1e−18 | 46 |
| 310 | -700085230 | 700085230H1 | SATMON011 | g2708744 | BLASTN | 288 | 1e−41 | 60 |
| 311 | -700091647 | 700091647H1 | SATMON011 | g885730 | BLASTN | 66 | 1e−19 | 64 |
| 312 | -700100924 | 700100924H1 | SATMON009 | g2582645 | BLASTN | 136 | 1e−20 | 83 |
| 313 | -700105860 | 700105860H1 | SATMON010 | g1872521 | BLASTN | 115 | 1e−20 | 42 |
| 314 | -700156073 | 700156073H1 | SATMON007 | g1435057 | BLASTN | 129 | 1e−27 | 47 |
| 315 | -700162355 | 700162355H1 | SATMON012 | g2435518 | BLASTN | 211 | 1e−31 | 48 |
| 316 | -700164124 | 700164124H1 | SATMON013 | g1519680 | BLASTN | 130 | 1e−19 | 45 |
| 317 | -700164638 | 700164638H1 | SATMON013 | g3033395 | BLASTN | 94 | 1e−17 | 48 |
| 318 | -700167644 | 700167644H1 | SATMON013 | g2582643 | BLASTN | 94 | 1e−17 | 91 |
| 319 | -700168811 | 700168811H1 | SATMON013 | g2104419 | BLASTN | 114 | 1e−19 | 50 |
| 320 | -700172615 | 700172615H1 | SATMON013 | g1304599 | BLASTN | 136 | 1e−26 | 45 |
| 321 | -700196512 | 700196512H1 | SATMON014 | g532810 | BLASTN | 116 | 1e−27 | 50 |
| 322 | -700201723 | 700201723H1 | SATMON003 | g1843401 | BLASTN | 122 | 1e−18 | 41 |
| 323 | -700203560 | 700203560H1 | SATMON003 | g2058504 | BLASTN | 123 | 1e−19 | 67 |
| 324 | -700214674 | 700214674H1 | SATMON016 | g18819 | BLASTN | 159 | 1e−24 | 70 |
| 325 | -700219515 | 700219515H1 | SATMON011 | g1182006 | BLASTN | 524 | 1e−33 | 89 |
| 326 | -700219825 | 700219825H1 | SATMON011 | g166306 | BLASTN | 182 | 1e−35 | 61 |
| 327 | -700220954 | 700220954H1 | SATMON011 | g1871192 | BLASTN | 77 | 1e−21 | 49 |
| 328 | -700235252 | 700235252H1 | SATMON010 | g1136384 | BLASTN | 99 | 1e−17 | 37 |
| 329 | -700237256 | 700237256H1 | SATMON010 | g1565227 | BLASTN | 116 | 1e−27 | 66 |
| 330 | -700240108 | 700240108H1 | SATMON010 | g2160396 | BLASTN | 161 | 1e−24 | 44 |
| 331 | -700242130 | 700242130H1 | SATMON010 | g1183987 | BLASTN | 101 | 1e−22 | 57 |
| 332 | -700257451 | 700257451H2 | SATMON017 | g1871192 | BLASTN | 205 | 1e−36 | 59 |
| 333 | -700321754 | 700321754H1 | SATMON025 | g1304599 | BLASTN | 144 | 1e−21 | 43 |
| 334 | -700341394 | 700341394H1 | SATMON020 | g2911058 | BLASTN | 150 | 1e−22 | 67 |
| 335 | -700341946 | 700341946H1 | SATMON020 | g2104677 | BLASTN | 97 | 1e−28 | 60 |
| 336 | -700345248 | 700345248H1 | SATMON021 | g2746333 | BLASTN | 140 | 1e−21 | 47 |
| 337 | -700352228 | 700352228H1 | SATMON023 | g2827537 | BLASTN | 343 | 1e−49 | 76 |
| 338 | -700353885 | 700353885H1 | SATMON024 | g1438877 | BLASTN | 162 | 1e−28 | 53 |
| 339 | -700381224 | 700381224H1 | SATMON023 | g469800 | BLASTN | 145 | 1e−21 | 64 |
| 340 | -700405481 | 700405481H1 | SATMON029 | g2708744 | BLASTN | 317 | 1e−45 | 60 |
| 341 | -700423875 | 700423875H1 | SATMONN01 | g2911058 | BLASTN | 164 | 1e−24 | 67 |
| 342 | -700431146 | 700431146H1 | SATMONN01 | g2435518 | BLASTN | 232 | 1e−34 | 44 |
| 343 | -700438785 | 700438785H1 | SATMON026 | g1872523 | BLASTN | 128 | 1e−19 | 61 |
| 344 | -700445561 | 700445561H1 | SATMON027 | g485815 | BLASTN | 278 | 1e−12 | 83 |
| 345 | -700452922 | 700452922H1 | SATMON028 | g1182006 | BLASTN | 451 | 1e−39 | 80 |
| 346 | -700453237 | 700453237H1 | SATMON028 | g2598954 | BLASTN | 79 | 1e−17 | 53 |
| 347 | -700456055 | 700456055H1 | SATMON029 | g2827537 | BLASTN | 168 | 1e−29 | 80 |
| 348 | -700477970 | 700477970H1 | SATMON025 | g2582645 | BLASTN | 78 | 1e−18 | 46 |
| 349 | -700575550 | 700575550H1 | SATMON030 | g2464919 | BLASTN | 214 | 1e−31 | 69 |
| 350 | -700582866 | 700582866H1 | SATMON031 | g2522524 | BLASTN | 127 | 1e−21 | 58 |
| 351 | -700611202 | 700611202H1 | SATMON022 | g2827537 | BLASTN | 148 | 1e−31 | 64 |
| 352 | -700614785 | 700614785H1 | SATMON033 | g1946361 | BLASTN | 184 | 1e−27 | 44 |
| 353 | -700621114 | 700621114H1 | SATMON034 | g2738419 | BLASTN | 80 | 1e−17 | 48 |
| 354 | -700807291 | 700807291H1 | SATMON036 | g2911058 | BLASTN | 121 | 1e−18 | 37 |
| 355 | -701158987 | 701158987H2 | SATMONN04 | g1182006 | BLASTN | 469 | 1e−39 | 85 |
| 356 | -701160730 | 701160730H1 | SATMONN04 | g20546 | BLASTN | 128 | 1e−23 | 63 |
| 357 | -701176142 | 701176142H1 | SATMONN05 | g1946361 | BLASTN | 144 | 1e−21 | 40 |
| 358 | -701176323 | 701176323H1 | SATMONN05 | g2894600 | BLASTN | 163 | 1e−24 | 48 |
| 359 | -701179810 | 701179810H1 | SATMONN05 | g2618693 | BLASTN | 114 | 1e−17 | 33 |
| 360 | -701180481 | 701180481H1 | SATMONN05 | g532813 | BLASTN | 239 | 1e−36 | 59 |
| 361 | -701181264 | 701181264H1 | SATMONN06 | g2911058 | BLASTN | 128 | 1e−19 | 45 |
| 362 | 1035 | 700077089H1 | SATMON007 | g1401053 | BLASTN | 112 | 1e−31 | 51 |
| 363 | 1035 | 700090214H1 | SATMON011 | g1209779 | BLASTN | 97 | 1e−30 | 51 |
| 364 | 1035 | 700203251H1 | SATMON003 | g1401053 | BLASTN | 97 | 1e−27 | 57 |
| 365 | 1035 | 700260407H1 | SATMON017 | g1401053 | BLASTN | 77 | 1e−21 | 53 |
| 366 | 1035 | 700431103H1 | SATMONN01 | g1401066 | BLASTN | 97 | 1e−21 | 59 |
| 367 | 1035 | 700571514H1 | SATMON030 | g1209779 | BLASTN | 97 | 1e−23 | 58 |
| 368 | 1035 | LIB3067-003-Q1-K1-D11 | LIB3067 | g1209779 | BLASTN | 135 | 1e−51 | 48 |
| 369 | 10824 | 700026992H1 | SATMON003 | g2511546 | BLASTN | 107 | 1e−21 | 68 |
| 370 | 10824 | 700027527H1 | SATMON003 | g2511546 | BLASTN | 116 | 1e−22 | 71 |
| 371 | 10824 | 700102056H1 | SATMON010 | g2511546 | BLASTN | 107 | 1e−21 | 68 |
| 372 | 10824 | 700103281H1 | SATMON010 | g2511546 | BLASTN | 108 | 1e−21 | 68 |
| 373 | 10824 | 700204592H1 | SATMON003 | g2981169 | BLASTN | 103 | 1e−19 | 59 |
| 374 | 11449 | 700157020H1 | SATMON012 | g1872521 | BLASTN | 151 | 1e−30 | 65 |
| 375 | 11449 | 700159984H1 | SATMON012 | g1872521 | BLASTN | 151 | 1e−23 | 71 |
| 376 | 11477 | 700048922H1 | SATMON003 | g441220 | BLASTN | 495 | 1e−39 | 84 |
| 377 | 11477 | LIB84-008-Q1-E1-F10 | LIB84 | g485815 | BLASTN | 578 | 1e−39 | 78 |
| 378 | 11477 | LIB84-008-Q1-E1-F8 | LIB84 | g485815 | BLASTN | 457 | 1e−37 | 82 |
| 379 | 11715 | 700167124H1 | SATMON013 | g995854 | BLASTN | 184 | 1e−27 | 50 |

-continued

MAIZE ZINC-FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 380 | 11715 | 700338785H1 | SATMON020 | g995854 | BLASTN | 181 | 1e−27 | 67 |
| 381 | 11824 | 700427090H1 | SATMONN01 | g2746333 | BLASTN | 116 | 1e−23 | 52 |
| 382 | 11824 | 700805029H1 | SATMON036 | g2746333 | BLASTN | 116 | 1e−19 | 53 |
| 383 | 11824 | 701175485H1 | SATMONN05 | g1321818 | BLASTN | 108 | 1e−21 | 50 |
| 384 | 12985 | 700152577H1 | SATMON007 | g2708744 | BLASTN | 144 | 1e−21 | 45 |
| 385 | 12985 | 700261113H1 | SATMON017 | g2708744 | BLASTN | 220 | 1e−33 | 49 |
| 386 | 13680 | 700351911H1 | SATMON023 | g1519680 | BLASTN | 132 | 1e−20 | 47 |
| 387 | 13763 | 700050261H1 | SATMON003 | g558542 | BLASTN | 235 | 1e−08 | 77 |
| 388 | 1432 | 700432237H1 | SATMONN01 | g1773040 | BLASTN | 111 | 1e−19 | 60 |
| 389 | 15019 | 700171514H1 | SATMON013 | g559102 | BLASTN | 71 | 1e−21 | 65 |
| 390 | 15100 | 700527747H1 | SATMON030 | g4023 | BLASTN | 144 | 1e−35 | 60 |
| 391 | 15427 | 700431701H1 | SATMONN01 | g2618752 | BLASTN | 231 | 1e−34 | 66 |
| 392 | 15427 | 700431705H1 | SATMONN01 | g2618752 | BLASTN | 232 | 1e−34 | 68 |
| 393 | 16208 | 700468750H1 | SATMON025 | g1872521 | BLASTN | 111 | 1e−23 | 70 |
| 394 | 16208 | LIB143-057-Q1-E1-C3 | LIB143 | g1872521 | BLASTN | 121 | 1e−41 | 60 |
| 395 | 16208 | LIB148-018-Q1-E1-D8 | LIB148 | g1872521 | BLASTN | 152 | 1e−48 | 63 |
| 396 | 16208 | LIB3066-038-Q1-K1-D2 | LIB3066 | g1872521 | BLASTN | 135 | 1e−40 | 61 |
| 397 | 16918 | 700043104H1 | SATMON004 | g2746333 | BLASTN | 142 | 1e−21 | 52 |
| 398 | 16918 | 700044140H1 | SATMON004 | g1321818 | BLASTN | 142 | 1e−21 | 52 |
| 399 | 16918 | 700549778H1 | SATMON022 | g2746333 | BLASTN | 172 | 1e−25 | 50 |
| 400 | 16918 | 700551474H1 | SATMON022 | g2746333 | BLASTN | 159 | 1e−23 | 53 |
| 401 | 17154 | 700159007H1 | SATMON012 | g2911058 | BLASTN | 311 | 1e−44 | 63 |
| 402 | 17154 | 700581847H1 | SATMON031 | g2911058 | BLASTN | 298 | 1e−43 | 60 |
| 403 | 17154 | 700581848H1 | SATMON031 | g2911058 | BLASTN | 150 | 1e−36 | 57 |
| 404 | 17200 | 700161005H1 | SATMON012 | g2911058 | BLASTN | 141 | 1e−21 | 75 |
| 405 | 18363 | 700102068H1 | SATMON010 | g1304599 | BLASTN | 107 | 1e−20 | 54 |
| 406 | 18363 | 700235979H1 | SATMON010 | g1304599 | BLASTN | 227 | 1e−33 | 54 |
| 407 | 18643 | 700088171H1 | SATMON011 | g2582645 | BLASTN | 206 | 1e−30 | 78 |
| 408 | 18643 | 700552484H1 | SATMON022 | g2582645 | BLASTN | 112 | 1e−17 | 79 |
| 409 | 18643 | 701163712H1 | SATMONN04 | g2582645 | BLASTN | 136 | 1e−38 | 76 |
| 410 | 18643 | 701171379H2 | SATMONN05 | g2582645 | BLASTN | 182 | 1e−32 | 72 |
| 411 | 18643 | LIB3060-042-Q1-K1-C3 | LIB3060 | g2582644 | BLASTN | 449 | 1e−27 | 72 |
| 412 | 1870 | 700018305H1 | SATMON001 | g1182006 | BLASTN | 781 | 1e−56 | 91 |
| 413 | 1870 | 700020004H1 | SATMON001 | g1182006 | BLASTN | 623 | 1e−43 | 88 |
| 414 | 1870 | 700020158H1 | SATMON001 | g1182006 | BLASTN | 760 | 1e−55 | 88 |
| 415 | 1870 | 700021541H1 | SATMON001 | g732811 | BLASTN | 179 | 1e−28 | 100 |
| 416 | 1870 | 700026616H1 | SATMON003 | g1182006 | BLASTN | 387 | 1e−24 | 87 |
| 417 | 1870 | 700029430H1 | SATMON003 | g1182006 | BLASTN | 772 | 1e−56 | 87 |
| 418 | 1870 | 700029830H1 | SATMON003 | g1182006 | BLASTN | 790 | 1e−57 | 87 |
| 419 | 1870 | 700047759H1 | SATMON003 | g1182006 | BLASTN | 760 | 1e−70 | 88 |
| 420 | 1870 | 700082430H1 | SATMON011 | g1182006 | BLASTN | 633 | 1e−44 | 82 |
| 421 | 1870 | 700084430H1 | SATMON011 | g1182006 | BLASTN | 911 | 1e−69 | 85 |
| 422 | 1870 | 700085075H1 | SATMON011 | g1182006 | BLASTN | 447 | 1e−27 | 84 |
| 423 | 1870 | 700087465H1 | SATMON011 | g1182006 | BLASTN | 763 | 1e−55 | 82 |
| 424 | 1870 | 700105379H1 | SATMON010 | g1182006 | BLASTN | 876 | 1e−65 | 85 |
| 425 | 1870 | 700150246H1 | SATMON007 | g1182006 | BLASTN | 510 | 1e−33 | 88 |
| 426 | 1870 | 700201345H1 | SATMON003 | g1182006 | BLASTN | 965 | 1e−74 | 87 |
| 427 | 1870 | 700202069H1 | SATMON003 | g1182006 | BLASTN | 926 | 1e−70 | 89 |
| 428 | 1870 | 700217723H1 | SATMON016 | g1182006 | BLASTN | 665 | 1e−56 | 91 |
| 429 | 1870 | 700237291H1 | SATMON010 | g1182006 | BLASTN | 747 | 1e−54 | 88 |
| 430 | 1870 | 700340470H1 | SATMON020 | g1182006 | BLASTN | 816 | 1e−60 | 84 |
| 431 | 1870 | 700341616H1 | SATMON020 | g1182006 | BLASTN | 526 | 1e−34 | 82 |
| 432 | 1870 | 700353508H1 | SATMON024 | g1182006 | BLASTN | 980 | 1e−75 | 85 |
| 433 | 1870 | 700426268H1 | SATMONN01 | g1182006 | BLASTN | 927 | 1e−70 | 86 |
| 434 | 1870 | 700446271H1 | SATMON027 | g1182006 | BLASTN | 892 | 1e−66 | 84 |
| 435 | 1870 | 700446372H1 | SATMON027 | g1182006 | BLASTN | 642 | 1e−45 | 87 |
| 436 | 1870 | 700449457H1 | SATMON028 | g1182006 | BLASTN | 621 | 1e−43 | 82 |
| 437 | 1870 | 700449903H1 | SATMON028 | g1182006 | BLASTN | 760 | 1e−55 | 87 |
| 438 | 1870 | 700452486H1 | SATMON028 | g1182006 | BLASTN | 612 | 1e−54 | 90 |
| 439 | 1870 | 700453241H1 | SATMON028 | g1182006 | BLASTN | 692 | 1e−49 | 87 |
| 440 | 1870 | 700572095H1 | SATMON030 | g1182006 | BLASTN | 414 | 1e−25 | 88 |
| 441 | 1870 | 700572123H1 | SATMON030 | g1182006 | BLASTN | 829 | 1e−61 | 82 |
| 442 | 1870 | 700572323H1 | SATMON030 | g1182006 | BLASTN | 585 | 1e−38 | 83 |
| 443 | 1870 | 700572910H1 | SATMON030 | g1182006 | BLASTN | 278 | 1e−14 | 84 |
| 444 | 1870 | 700572933H1 | SATMON030 | g1182006 | BLASTN | 893 | 1e−67 | 84 |
| 445 | 1870 | 700572946H1 | SATMON030 | g1182006 | BLASTN | 525 | 1e−47 | 87 |
| 446 | 1870 | 700573249H1 | SATMON030 | g1182006 | BLASTN | 931 | 1e−71 | 82 |
| 447 | 1870 | 700576123H1 | SATMON030 | g1182006 | BLASTN | 906 | 1e−68 | 83 |
| 448 | 1870 | 700582788H1 | SATMON031 | g732811 | BLASTN | 85 | 1e−35 | 89 |
| 449 | 1870 | 700622147H1 | SATMON034 | g1182006 | BLASTN | 570 | 1e−54 | 83 |

-continued

MAIZE ZINC-FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 450 | 1870 | 700622250H1 | SATMON034 | g1182006 | BLASTN | 779 | 1e−56 | 84 |
| 451 | 1870 | 700622392H1 | SATMON034 | g1182006 | BLASTN | 579 | 1e−47 | 87 |
| 452 | 1870 | 700624362H1 | SATMON034 | g732811 | BLASTN | 152 | 1e−38 | 98 |
| 453 | 1870 | 700804615H1 | SATMON036 | g1182006 | BLASTN | 761 | 1e−55 | 87 |
| 454 | 1870 | 700806127H1 | SATMON036 | g1182006 | BLASTN | 643 | 1e−45 | 88 |
| 455 | 1870 | 701163755H1 | SATMONN04 | g1182006 | BLASTN | 731 | 1e−52 | 87 |
| 456 | 1870 | 701166834H1 | SATMONN04 | g1182006 | BLASTN | 364 | 1e−51 | 88 |
| 457 | 1870 | 701182594H1 | SATMONN06 | g1182006 | BLASTN | 616 | 1e−50 | 86 |
| 458 | 1870 | LIB143-004-Q1-E1-H5 | LIB143 | g1182006 | BLASTN | 921 | 1e−70 | 87 |
| 459 | 1870 | LIB143-008-Q1-E1-D11 | LIB143 | g1182006 | BLASTN | 285 | 1e−27 | 81 |
| 460 | 1870 | LIB3059-041-Q1-K1-H6 | LIB3059 | g1182006 | BLASTN | 790 | 1e−56 | 83 |
| 461 | 1870 | LIB3059-033-Q1-K1-F8 | LIB3059 | g1182006 | BLASTN | 628 | 1e−42 | 82 |
| 462 | 1870 | LIB3061-022-Q1-K1-A3 | LIB3061 | g1182006 | BLASTN | 965 | 1e−74 | 87 |
| 463 | 1870 | LIB3061-045-Q1-K1-E4 | LIB3061 | g1182006 | BLASTN | 888 | 1e−66 | 84 |
| 464 | 1870 | LIB3061-048-Q1-K1-C1 | LIB3061 | g1182006 | BLASTN | 888 | 1e−66 | 84 |
| 465 | 1870 | LIB3067-040-Q1-K1-B9 | LIB3067 | g1182006 | BLASTN | 936 | 1e−71 | 88 |
| 466 | 1870 | LIB3067-033-Q1-K1-G7 | LIB3067 | g1182006 | BLASTN | 974 | 1e−74 | 88 |
| 467 | 1870 | LIB3067-053-Q1-K1-H1 | LIB3067 | g1182006 | BLASTN | 872 | 1e−65 | 86 |
| 468 | 1870 | LIB3069-008-Q1-K1-F4 | LIB3069 | g1182006 | BLASTN | 888 | 1e−66 | 84 |
| 469 | 1870 | LIB3069-026-Q1-K1-D10 | LIB3069 | g1182006 | BLASTN | 902 | 1e−68 | 85 |
| 470 | 1870 | LIB3078-007-Q1-K1-E5 | LIB3078 | g1182006 | BLASTN | 906 | 1e−68 | 84 |
| 471 | 1870 | LIB3078-039-Q1-K1-D5 | LIB3078 | g1182006 | BLASTN | 893 | 1e−67 | 84 |
| 472 | 1870 | LIB36-014-Q1-E1-C9 | LIB36 | g1182006 | BLASTN | 720 | 1e−50 | 84 |
| 473 | 1870 | LIB83-015-Q1-E1-F2 | LIB83 | g1182006 | BLASTN | 893 | 1e−67 | 84 |
| 474 | 1870 | LIB84-025-Q1-E1-F7 | LIB84 | g1182006 | BLASTN | 411 | 1e−28 | 88 |
| 475 | 19382 | 700258847H1 | SATMON017 | g1872521 | BLASTN | 141 | 1e−25 | 58 |
| 476 | 19382 | 700423860H1 | SATMONN01 | g1872521 | BLASTN | 152 | 1e−34 | 63 |
| 477 | 19599 | 700569343H1 | SATMON030 | g2582645 | BLASTN | 76 | 1e−20 | 82 |
| 478 | 19820 | 700215466H1 | SATMON016 | g1773040 | BLASTN | 119 | 1e−18 | 62 |
| 479 | 19820 | 700470380H1 | SATMON025 | g1773040 | BLASTN | 129 | 1e−19 | 69 |
| 480 | 2055 | 700441860H1 | SATMON026 | g1321818 | BLASTN | 127 | 1e−22 | 51 |
| 481 | 21017 | 700211455H1 | SATMON016 | g2960035 | BLASTN | 122 | 1e−23 | 47 |
| 482 | 21113 | 700382252H1 | SATMON024 | g1946361 | BLASTN | 111 | 1e−19 | 36 |
| 483 | 21118 | 700244059H1 | SATMON010 | g2435518 | BLASTN | 122 | 1e−26 | 73 |
| 484 | 21298 | 700048701H1 | SATMON003 | g2582645 | BLASTN | 176 | 1e−32 | 77 |
| 485 | 21298 | 700095050H1 | SATMON008 | g2582645 | BLASTN | 189 | 1e−28 | 78 |
| 486 | 21298 | 700101269H1 | SATMON009 | g2582644 | BLASTN | 524 | 1e−33 | 73 |
| 487 | 21298 | 700151889H1 | SATMON007 | g2582645 | BLASTN | 226 | 1e−34 | 78 |
| 488 | 21460 | 700083781H1 | SATMON011 | g2582643 | BLASTN | 94 | 1e−21 | 85 |
| 489 | 21460 | 700162856H1 | SATMON013 | g2582643 | BLASTN | 94 | 1e−20 | 90 |
| 490 | 22148 | 700582334H1 | SATMON031 | g2911058 | BLASTN | 275 | 1e−43 | 63 |
| 491 | 22241 | 700465691H1 | SATMON025 | g2708744 | BLASTN | 107 | 1e−18 | 38 |
| 492 | 22241 | 700466091H1 | SATMON025 | g2708744 | BLASTN | 106 | 1e−26 | 41 |
| 493 | 23254 | 701178810H1 | SATMONN05 | g924620 | BLASTN | 172 | 1e−37 | 56 |
| 494 | 23254 | 701179020H1 | SATMONN05 | g924620 | BLASTN | 204 | 1e−30 | 48 |
| 495 | 24947 | 700612580H1 | SATMON033 | g1438877 | BLASTN | 151 | 1e−22 | 43 |
| 496 | 24947 | 701166350H1 | SATMONN04 | g1438877 | BLASTN | 166 | 1e−24 | 41 |
| 497 | 24947 | LIB3060-010-Q1-K1-A4 | LIB3060 | g1438877 | BLASTN | 162 | 1e−43 | 40 |
| 498 | 24947 | LIB3067-048-Q1-K1-D6 | LIB3067 | g1438877 | BLASTN | 153 | 1e−37 | 43 |
| 499 | 26135 | LIB3062-035-Q1-K1-F5 | LIB3062 | g558542 | BLASTN | 308 | 1e−14 | 67 |
| 500 | 27359 | 700030456H1 | SATMON003 | g3033388 | BLASTN | 204 | 1e−30 | 62 |
| 501 | 28039 | 700193021H1 | SATMON014 | g2827537 | BLASTN | 98 | 1e−17 | 78 |
| 502 | 28039 | LIB143-066-Q1-E1-D11 | LIB143 | g2827537 | BLASTN | 98 | 1e−38 | 57 |

-continued

MAIZE ZINC-FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 503 | 2972 | 700204107H1 | SATMON003 | g1872521 | BLASTN | 149 | 1e−22 | 64 |
| 504 | 2972 | 700215661H1 | SATMON016 | g1872523 | BLASTN | 149 | 1e−25 | 62 |
| 505 | 2972 | 700242431H1 | SATMON010 | g1872521 | BLASTN | 149 | 1e−37 | 65 |
| 506 | 2972 | 700343436H1 | SATMON021 | g1872521 | BLASTN | 149 | 1e−30 | 65 |
| 507 | 2972 | 700352888H1 | SATMON024 | g1872521 | BLASTN | 146 | 1e−33 | 69 |
| 508 | 2972 | 700382460H1 | SATMON024 | g1872521 | BLASTN | 149 | 1e−30 | 69 |
| 509 | 2972 | 700579507H1 | SATMON031 | g1872521 | BLASTN | 135 | 1e−23 | 59 |
| 510 | 30492 | 700576046H1 | SATMON030 | g2746333 | BLASTN | 121 | 1e−21 | 53 |
| 511 | 30619 | LIB3067-019-Q1-K1-G10 | LIB3067 | g1438877 | BLASTN | 102 | 1e−36 | 48 |
| 512 | 31779 | 700439823H1 | SATMON026 | g2911058 | BLASTN | 145 | 1e−25 | 54 |
| 513 | 31780 | LIB3066-006-Q1-K1-B8 | LIB3066 | g2435518 | BLASTN | 205 | 1e−59 | 49 |
| 514 | 31839 | 700443745H1 | SATMON027 | g2827537 | BLASTN | 155 | 1e−28 | 61 |
| 515 | 31839 | LIB3061-001-Q1-K2-F2 | LIB3061 | g2827537 | BLASTN | 155 | 1e−50 | 65 |
| 516 | 3203 | 700042448H1 | SATMON004 | g1872523 | BLASTN | 83 | 1e−20 | 75 |
| 517 | 3203 | LIB189-024-Q1-E1-B3 | LIB189 | g1872521 | BLASTN | 92 | 1e−40 | 70 |
| 518 | 3203 | LIB3062-003-Q1-K1-F4 | LIB3062 | g1872521 | BLASTN | 83 | 1e−40 | 61 |
| 519 | 3203 | LIB3078-034-Q1-K1-G8 | LIB3078 | g1872521 | BLASTN | 83 | 1e−34 | 71 |
| 520 | 32258 | LIB3062-024-Q1-K1-H10 | LIB3062 | g3152606 | BLASTN | 159 | 1e−53 | 61 |
| 521 | 32618 | 700164830H1 | SATMON013 | g2746335 | BLASTN | 164 | 1e−24 | 56 |
| 522 | 32618 | LIB83-002-Q1-E1-A11 | LIB83 | g1321818 | BLASTN | 180 | 1e−42 | 50 |
| 523 | 4116 | 700021533H1 | SATMON001 | g18819 | BLASTN | 310 | 1e−47 | 77 |
| 524 | 4116 | 700021703H1 | SATMON001 | g18819 | BLASTN | 336 | 1e−50 | 78 |
| 525 | 4116 | 700088936H1 | SATMON011 | g18819 | BLASTN | 225 | 1e−33 | 62 |
| 526 | 4116 | 700104150H1 | SATMON010 | g18819 | BLASTN | 374 | 1e−55 | 74 |
| 527 | 4116 | 700155735H1 | SATMON007 | g18819 | BLASTN | 262 | 1e−39 | 74 |
| 528 | 4116 | 700163155H1 | SATMON013 | g18819 | BLASTN | 321 | 1e−48 | 78 |
| 529 | 4116 | 700164940H1 | SATMON013 | g18819 | BLASTN | 313 | 1e−47 | 75 |
| 530 | 4116 | 700167001H1 | SATMON013 | g18819 | BLASTN | 319 | 1e−48 | 77 |
| 531 | 4116 | 700169123H1 | SATMON013 | g18819 | BLASTN | 214 | 1e−32 | 76 |
| 532 | 4116 | 700172257H1 | SATMON013 | g18819 | BLASTN | 290 | 1e−44 | 76 |
| 533 | 4116 | 700208410H1 | SATMON016 | g18819 | BLASTN | 126 | 1e−21 | 78 |
| 534 | 4116 | 700214491H1 | SATMON016 | g18819 | BLASTN | 144 | 1e−22 | 75 |
| 535 | 4116 | 700217884H1 | SATMON016 | g18819 | BLASTN | 287 | 1e−43 | 78 |
| 536 | 4116 | 700218119H1 | SATMON016 | g18819 | BLASTN | 336 | 1e−50 | 77 |
| 537 | 4116 | 700220941H1 | SATMON011 | g18819 | BLASTN | 262 | 1e−39 | 75 |
| 538 | 4116 | 700221214H1 | SATMON011 | g18819 | BLASTN | 245 | 1e−45 | 77 |
| 539 | 4116 | 700223354H1 | SATMON011 | g18819 | BLASTN | 325 | 1e−49 | 78 |
| 540 | 4116 | 700239456H1 | SATMON010 | g18819 | BLASTN | 328 | 1e−49 | 70 |
| 541 | 4116 | 700332271H1 | SATMON019 | g18819 | BLASTN | 371 | 1e−55 | 78 |
| 542 | 4116 | 700334087H1 | SATMON019 | g18819 | BLASTN | 267 | 1e−48 | 75 |
| 543 | 4116 | 700334247H1 | SATMON019 | g18819 | BLASTN | 207 | 1e−31 | 77 |
| 544 | 4116 | 700348818H1 | SATMON023 | g18819 | BLASTN | 354 | 1e−53 | 77 |
| 545 | 4116 | 700350932H1 | SATMON023 | g18819 | BLASTN | 199 | 1e−42 | 64 |
| 546 | 4116 | 700352473H1 | SATMON023 | g18819 | BLASTN | 256 | 1e−38 | 65 |
| 547 | 4116 | 700553074H1 | SATMON022 | g18819 | BLASTN | 86 | 1e−26 | 67 |
| 548 | 4116 | 700553178H1 | SATMON022 | g18819 | BLASTN | 202 | 1e−36 | 73 |
| 549 | 4116 | 700571301H1 | SATMON030 | g18819 | BLASTN | 326 | 1e−55 | 60 |
| 550 | 4116 | 700614281H1 | SATMON033 | g18819 | BLASTN | 142 | 1e−53 | 69 |
| 551 | 4116 | 701165130H1 | SATMONN04 | g18819 | BLASTN | 230 | 1e−39 | 73 |
| 552 | 4116 | LIB143-010-Q1-E1-B7 | LIB143 | g18819 | BLASTN | 365 | 1e−82 | 71 |
| 553 | 4116 | LIB3062-039-Q1-K1-A5 | LIB3062 | g18819 | BLASTN | 373 | 1e−75 | 71 |
| 554 | 4116 | LIB3069-020-Q1-K1-E12 | LIB3069 | g18819 | BLASTN | 265 | 1e−63 | 51 |
| 555 | 4334 | LIB3062-030-Q1-K1-A5 | LIB3062 | g18819 | BLASTN | 93 | 1e−35 | 66 |
| 556 | 452 | 700045837H1 | SATMON004 | g2582645 | BLASTN | 203 | 1e−30 | 77 |
| 557 | 452 | 700083915H1 | SATMON011 | g2582645 | BLASTN | 221 | 1e−45 | 79 |
| 558 | 452 | 700096028H1 | SATMON008 | g2582645 | BLASTN | 207 | 1e−34 | 73 |
| 559 | 452 | 700156370H1 | SATMON007 | g2582645 | BLASTN | 214 | 1e−45 | 77 |
| 560 | 452 | 700203270H1 | SATMON003 | g2582643 | BLASTN | 218 | 1e−47 | 75 |
| 561 | 452 | 700203527H1 | SATMON003 | g2582645 | BLASTN | 182 | 1e−29 | 82 |
| 562 | 452 | 700218584H1 | SATMON011 | g2582645 | BLASTN | 111 | 1e−19 | 81 |
| 563 | 452 | 700334194H1 | SATMON019 | g2582645 | BLASTN | 168 | 1e−25 | 76 |
| 564 | 452 | 700351576H1 | SATMON023 | g2582645 | BLASTN | 138 | 1e−37 | 70 |

MAIZE ZINC-FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 565 | 452 | 700378354H1 | SATMON019 | g2582643 | BLASTN | 212 | 1e-42 | 72 |
| 566 | 452 | 700429589H1 | SATMONN01 | g2582645 | BLASTN | 120 | 1e-18 | 79 |
| 567 | 452 | 700441669H1 | SATMON026 | g2582645 | BLASTN | 220 | 1e-35 | 78 |
| 568 | 452 | 700442551H1 | SATMON026 | g2582645 | BLASTN | 214 | 1e-35 | 74 |
| 569 | 452 | 700442588H1 | SATMON026 | g2582645 | BLASTN | 208 | 1e-31 | 73 |
| 570 | 452 | 700474743H1 | SATMON025 | g2582645 | BLASTN | 127 | 1e-27 | 63 |
| 571 | 452 | 700475070H1 | SATMON025 | g2582645 | BLASTN | 211 | 1e-31 | 76 |
| 572 | 452 | 700475920H1 | SATMON025 | g2582645 | BLASTN | 123 | 1e-40 | 76 |
| 573 | 452 | 700622239H1 | SATMON034 | g2582645 | BLASTN | 214 | 1e-45 | 76 |
| 574 | 452 | 700801114H1 | SATMON036 | g2582645 | BLASTN | 198 | 1e-29 | 81 |
| 575 | 452 | 700801146H1 | SATMON036 | g2582645 | BLASTN | 160 | 1e-24 | 71 |
| 576 | 452 | 701185466H1 | SATMONN06 | g2582645 | BLASTN | 177 | 1e-26 | 72 |
| 577 | 452 | LIB143-023-Q1-E1-A7 | LIB143 | g2582643 | BLASTN | 208 | 1e-51 | 58 |
| 578 | 4605 | 700345737H1 | SATMON021 | g1001957 | BLASTN | 84 | 1e-17 | 40 |
| 579 | 4959 | 700029702H1 | SATMON003 | g2738449 | BLASTN | 124 | 1e-19 | 38 |
| 580 | 4959 | 700030133H1 | SATMON003 | g2738449 | BLASTN | 125 | 1e-19 | 36 |
| 581 | 4959 | 700159379H1 | SATMON012 | g2738449 | BLASTN | 114 | 1e-17 | 44 |
| 582 | 4959 | 700215552H1 | SATMON016 | g2738449 | BLASTN | 112 | 1e-17 | 44 |
| 583 | 4959 | 700235857H1 | SATMON010 | g2738449 | BLASTN | 124 | 1e-19 | 38 |
| 584 | 4959 | 700548858H1 | SATMON022 | g2738449 | BLASTN | 117 | 1e-18 | 43 |
| 585 | 5352 | 700094269H1 | SATMON008 | g2708744 | BLASTN | 278 | 1e-40 | 49 |
| 586 | 7136 | 700801832H1 | SATMON036 | g732811 | BLASTN | 77 | 1e-26 | 76 |
| 587 | 7136 | 700803283H1 | SATMON036 | g732811 | BLASTN | 77 | 1e-26 | 76 |
| 588 | 7965 | 700202917H1 | SATMON003 | g558543 | BLASTN | 120 | 1e-18 | 61 |
| 589 | 8800 | 700549224H1 | SATMON022 | g1707154 | BLASTN | 77 | 1e-18 | 54 |
| 590 | 8800 | 700549324H1 | SATMON022 | g1707154 | BLASTN | 78 | 1e-19 | 56 |
| 591 | 8895 | 700215423H1 | SATMON016 | g1871192 | BLASTN | 134 | 1e-27 | 53 |
| 592 | 8895 | 700265383H1 | SATMON017 | g1871192 | BLASTN | 84 | 1e-20 | 44 |
| 593 | 8929 | 700161625H1 | SATMON012 | g2582645 | BLASTN | 130 | 1e-20 | 78 |
| 594 | 8929 | 700433751H1 | SATMONN01 | g2582643 | BLASTN | 131 | 1e-20 | 64 |
| 595 | 8929 | LIB3062-044-Q1-K1-A11 | LIB3062 | g2582644 | BLASTN | 534 | 1e-43 | 75 |
| 596 | 9711 | 700142473H1 | SATMON012 | g2982466 | BLASTN | 131 | 1e-20 | 48 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 597 | -700019575 | 700019575H1 | SATMON001 | g1183866 | BLASTN | 177 | 1e-32 | 81 |
| 598 | -700019871 | 700019871H1 | SATMON001 | g1370276 | BLASTN | 122 | 1e-18 | 48 |
| 599 | -700020149 | 700020149H1 | SATMON001 | g786426 | BLASTN | 184 | 1e-27 | 90 |
| 600 | -700021543 | 700021543H1 | SATMON001 | g671868 | BLASTN | 114 | 1e-17 | 91 |
| 601 | -700026214 | 700026214H1 | SATMON003 | g21634 | BLASTN | 234 | 1e-08 | 93 |
| 602 | -700026342 | 700026342H1 | SATMON003 | g1946264 | BLASTN | 730 | 1e-52 | 86 |
| 603 | -700026663 | 700026663H1 | SATMON003 | g19490 | BLASTN | 166 | 1e-25 | 56 |
| 604 | -700026811 | 700026811H1 | SATMON003 | g2338034 | BLASTN | 46 | 1e-17 | 39 |
| 605 | -700027164 | 700027164H1 | SATMON003 | g2145358 | BLASTN | 136 | 1e-36 | 65 |
| 606 | -700027449 | 700027449H1 | SATMON003 | g1002796 | BLASTN | 98 | 1e-18 | 76 |
| 607 | -700028188 | 700028188H1 | SATMON003 | g2145358 | BLASTN | 161 | 1e-40 | 68 |
| 608 | -700028533 | 700028533H1 | SATMON003 | g556408 | BLASTN | 1062 | 1e-79 | 85 |
| 609 | -700046037 | 700046037H1 | SATMON004 | g22614 | BLASTN | 287 | 1e-13 | 74 |
| 610 | -700049432 | 700049432H1 | SATMON003 | g1420923 | BLASTN | 381 | 1e-44 | 76 |
| 611 | -700049692 | 700049692H1 | SATMON003 | g1430846 | BLASTN | 114 | 1e-19 | 56 |
| 612 | -700050495 | 700050495H1 | SATMON003 | g996020 | BLASTN | 112 | 1e-20 | 65 |
| 613 | -700051531 | 700051531H1 | SATMON003 | g2245390 | BLASTN | 192 | 1e-39 | 66 |
| 614 | -700052158 | 700052158H1 | SATMON003 | g1002800 | BLASTN | 130 | 1e-28 | 80 |
| 615 | -700053658 | 700053658H1 | SATMON010 | g556557 | BLASTN | 825 | 1e-59 | 86 |
| 616 | -700075928 | 700075928H1 | SATMON007 | g2104685 | BLASTN | 172 | 1e-25 | 67 |
| 617 | -700076670 | 700076670H1 | SATMON007 | g2826882 | BLASTN | 129 | 1e-21 | 54 |
| 618 | -700082219 | 700082219H1 | SATMON011 | g2062176 | BLASTN | 177 | 1e-26 | 61 |
| 619 | -700082978 | 700082978H1 | SATMON011 | g2104678 | BLASTN | 806 | 1e-58 | 75 |
| 620 | -700083837 | 700083837H1 | SATMON011 | g2398532 | BLASTN | 686 | 1e-48 | 76 |
| 621 | -700084491 | 700084491H1 | SATMON011 | g940880 | BLASTN | 360 | 1e-19 | 84 |
| 622 | -700084907 | 700084907H1 | SATMON011 | g2104678 | BLASTN | 335 | 1e-36 | 76 |
| 623 | -700084920 | 700084920H1 | SATMON011 | g1183865 | BLASTN | 259 | 1e-10 | 74 |
| 624 | -700085504 | 700085504H1 | SATMON011 | g2914703 | BLASTN | 313 | 1e-45 | 56 |
| 625 | -700086685 | 700086685H1 | SATMON011 | g1749546 | BLASTN | 117 | 1e-27 | 53 |

-continued

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 626 | -700090877 | 700090877H1 | SATMON011 | g1666172 | BLASTN | 241 | 1e−09 | 73 |
| 627 | -700092059 | 700092059H1 | SATMON008 | g671867 | BLASTN | 194 | 1e−29 | 80 |
| 628 | -700093458 | 700093458H1 | SATMON008 | g2104679 | BLASTN | 124 | 1e−19 | 42 |
| 629 | -700093517 | 700093517H1 | SATMON008 | g841308 | BLASTN | 90 | 1e−20 | 53 |
| 630 | -700095187 | 700095187H1 | SATMON008 | g2145358 | BLASTN | 107 | 1e−29 | 65 |
| 631 | -700095891 | 700095891H1 | SATMON008 | g2565210 | BLASTN | 129 | 1e−19 | 30 |
| 632 | -700095949 | 700095949H1 | SATMON008 | g556557 | BLASTN | 230 | 1e−10 | 79 |
| 633 | -700099947 | 700099947H1 | SATMON009 | g214819 | BLASTN | 90 | 1e−26 | 40 |
| 634 | -700101582 | 700101582H1 | SATMON009 | g218338 | BLASTN | 278 | 1e−40 | 85 |
| 635 | -700102210 | 700102210H1 | SATMON010 | g19491 | BLASTN | 565 | 1e−38 | 74 |
| 636 | -700102430 | 700102430H1 | SATMON010 | g1946264 | BLASTN | 638 | 1e−44 | 85 |
| 637 | -700103072 | 700103072H1 | SATMON010 | g928967 | BLASTN | 131 | 1e−37 | 83 |
| 638 | -700104061 | 700104061H1 | SATMON010 | g556557 | BLASTN | 698 | 1e−85 | 83 |
| 639 | -700106380 | 700106380H1 | SATMON010 | g556409 | BLASTN | 112 | 1e−17 | 88 |
| 640 | -700106429 | 700106429H1 | SATMON010 | g2160167 | BLASTN | 168 | 1e−25 | 85 |
| 641 | -700106570 | 700106570H1 | SATMON010 | g2104678 | BLASTN | 490 | 1e−30 | 76 |
| 642 | -700150553 | 700150553H1 | SATMON007 | g2462081 | BLASTN | 226 | 1e−39 | 62 |
| 643 | -700151146 | 700151146H1 | SATMON007 | g402685 | BLASTN | 217 | 1e−31 | 56 |
| 644 | -700151452 | 700151452H1 | SATMON007 | g786426 | BLASTN | 142 | 1e−21 | 86 |
| 645 | -700152353 | 700152353H1 | SATMON007 | g22194 | BLASTN | 948 | 1e−79 | 97 |
| 646 | -700152414 | 700152414H1 | SATMON007 | g2244754 | BLASTN | 110 | 1e−18 | 52 |
| 647 | -700154561 | 700154561H1 | SATMON007 | g22379 | BLASTN | 462 | 1e−29 | 93 |
| 648 | -700159416 | 700159416H1 | SATMON012 | g786426 | BLASTN | 86 | 1e−19 | 66 |
| 649 | -700161183 | 700161183H1 | SATMON012 | g2735839 | BLASTN | 199 | 1e−09 | 90 |
| 650 | -700161669 | 700161669H1 | SATMON012 | g309567 | BLASTN | 251 | 1e−10 | 78 |
| 651 | -700163369 | 700163369H1 | SATMON013 | g2735764 | BLASTN | 126 | 1e−19 | 44 |
| 652 | -700164247 | 700164247H1 | SATMON013 | g2145357 | BLASTN | 393 | 1e−32 | 70 |
| 653 | -700165604 | 700165604H1 | SATMON013 | g2997755 | BLASTN | 127 | 1e−19 | 52 |
| 654 | -700165931 | 700165931H1 | SATMON013 | g1420923 | BLASTN | 310 | 1e−24 | 85 |
| 655 | -700166173 | 700166173H1 | SATMON013 | g2196465 | BLASTN | 430 | 1e−25 | 63 |
| 656 | -700167056 | 700167056H1 | SATMON013 | g2062176 | BLASTN | 160 | 1e−25 | 76 |
| 657 | -700172749 | 700172749H1 | SATMON013 | g1747309 | BLASTN | 308 | 1e−26 | 71 |
| 658 | -700193495 | 700193495H1 | SATMON014 | g939780 | BLASTN | 463 | 1e−29 | 74 |
| 659 | -700194164 | 700194164H1 | SATMON014 | g1931638 | BLASTN | 109 | 1e−17 | 63 |
| 660 | -700194641 | 700194641H1 | SATMON014 | g854644 | BLASTN | 258 | 1e−10 | 86 |
| 661 | -700204208 | 700204208H1 | SATMON003 | g1946264 | BLASTN | 535 | 1e−44 | 78 |
| 662 | -700206189 | 700206189H1 | SATMON003 | g1420924 | BLASTN | 66 | 1e−17 | 38 |
| 663 | -700209275 | 700209275H1 | SATMON016 | g293905 | BLASTN | 1320 | 1e−101 | 97 |
| 664 | -700211270 | 700211270H1 | SATMON016 | g1945280 | BLASTN | 563 | 1e−38 | 83 |
| 665 | -700213420 | 700213420H1 | SATMON016 | g19259 | BLASTN | 608 | 1e−41 | 78 |
| 666 | -700213841 | 700213841H1 | SATMON016 | g945086 | BLASTN | 726 | 1e−51 | 78 |
| 667 | -700214202 | 700214202H1 | SATMON016 | g556558 | BLASTN | 92 | 1e−20 | 82 |
| 668 | -700215932 | 700215932H1 | SATMON016 | g1707009 | BLASTN | 256 | 1e−39 | 62 |
| 669 | -700216577 | 700216577H1 | SATMON016 | g2245389 | BLASTN | 432 | 1e−25 | 77 |
| 670 | -700217072 | 700217072H1 | SATMON016 | g791055 | BLASTN | 197 | 1e−30 | 56 |
| 671 | -700219211 | 700219211H1 | SATMON011 | g1183866 | BLASTN | 176 | 1e−33 | 61 |
| 672 | -700219745 | 700219745H1 | SATMON011 | g1945282 | BLASTN | 610 | 1e−42 | 73 |
| 673 | -700219809 | 700219809H1 | SATMON011 | g2145357 | BLASTN | 325 | 1e−45 | 81 |
| 674 | -700222781 | 700222781H1 | SATMON011 | g217859 | BLASTN | 236 | 1e−40 | 72 |
| 675 | -700224788 | 700224788H1 | SATMON011 | g2104678 | BLASTN | 572 | 1e−38 | 72 |
| 676 | -700235952 | 700235952H1 | SATMON010 | g1420923 | BLASTN | 253 | 1e−10 | 88 |
| 677 | -700237358 | 700237358H1 | SATMON010 | g786426 | BLASTN | 77 | 1e−18 | 59 |
| 678 | -700237443 | 700237443H1 | SATMON010 | g19058 | BLASTN | 500 | 1e−32 | 80 |
| 679 | -700237893 | 700237893H1 | SATMON010 | g2865393 | BLASTN | 1321 | 1e−101 | 99 |
| 680 | -700237918 | 700237918H1 | SATMON010 | g2832408 | BLASTN | 205 | 1e−39 | 73 |
| 681 | -700241453 | 700241453H1 | SATMON010 | g19058 | BLASTN | 447 | 1e−27 | 76 |
| 682 | -700241496 | 700241496H1 | SATMON010 | g1905943 | BLASTN | 290 | 1e−13 | 80 |
| 683 | -700241508 | 700241508H1 | SATMON010 | g556557 | BLASTN | 361 | 1e−19 | 84 |
| 684 | -700241792 | 700241792H1 | SATMON010 | g2443887 | BLASTN | 150 | 1e−28 | 51 |
| 685 | -700242839 | 700242839H1 | SATMON010 | g19051 | BLASTN | 101 | 1e−25 | 84 |
| 686 | -700243864 | 700243864H1 | SATMON010 | g1946264 | BLASTN | 496 | 1e−32 | 90 |
| 687 | -700258740 | 700258740H1 | SATMON017 | g940880 | BLASTN | 491 | 1e−75 | 88 |
| 688 | -700262211 | 700262211H1 | SATMON017 | g1171428 | BLASTN | 276 | 1e−25 | 75 |
| 689 | -700262747 | 700262747H1 | SATMON017 | g2104679 | BLASTN | 156 | 1e−23 | 77 |
| 690 | -700263302 | 700263302H1 | SATMON017 | g940880 | BLASTN | 316 | 1e−19 | 82 |
| 691 | -700264860 | 700264860H1 | SATMON017 | g1209099 | BLASTN | 125 | 1e−28 | 70 |
| 692 | -700265919 | 700265919H1 | SATMON017 | g886400 | BLASTN | 443 | 1e−26 | 74 |
| 693 | -700268135 | 700268135H1 | SATMON017 | g940880 | BLASTN | 325 | 1e−17 | 83 |
| 694 | -700281960 | 700281960H2 | SATMON021 | g22379 | BLASTN | 1474 | 1e−114 | 93 |
| 695 | -700332162 | 700332162H1 | SATMON019 | g2735764 | BLASTN | 120 | 1e−22 | 74 |
| 696 | -700336375 | 700336375H1 | SATMON019 | g307512 | BLASTN | 116 | 1e−17 | 57 |
| 697 | -700337421 | 700337421H1 | SATMON020 | g22192 | BLASTN | 373 | 1e−20 | 78 |
| 698 | -700343163 | 700343163H1 | SATMON021 | g2673911 | BLASTN | 93 | 1e−27 | 64 |
| 699 | -700344051 | 700344051H1 | SATMON021 | g2196465 | BLASTN | 356 | 1e−19 | 71 |

-continued

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 700 | -700345378 | 700345378H1 | SATMON021 | g2460124 | BLASTN | 120 | 1e-20 | 67 |
| 701 | -700350143 | 700350143H1 | SATMON023 | g1905933 | BLASTN | 521 | 1e-62 | 92 |
| 702 | -700350565 | 700350565H1 | SATMON023 | g854644 | BLASTN | 369 | 1e-55 | 96 |
| 703 | -700351026 | 700351026H1 | SATMON023 | g2145358 | BLASTN | 190 | 1e-41 | 81 |
| 704 | -700355409 | 700355409H1 | SATMON024 | g2088643 | BLASTN | 106 | 1e-20 | 59 |
| 705 | -700356229 | 700356229H1 | SATMON024 | g939780 | BLASTN | 377 | 1e-54 | 96 |
| 706 | -700383190 | 700383190H1 | SATMON024 | g886400 | BLASTN | 864 | 1e-63 | 85 |
| 707 | -700397574 | 700397574H1 | SATMONN01 | g786426 | BLASTN | 155 | 1e-23 | 61 |
| 708 | -700421862 | 700421862H1 | SATMONN01 | g2443887 | BLASTN | 100 | 1e-18 | 35 |
| 709 | -700422263 | 700422263H1 | SATMONN01 | g1931638 | BLASTN | 142 | 1e-21 | 70 |
| 710 | -700422519 | 700422519H1 | SATMONN01 | g2832406 | BLASTN | 196 | 1e-29 | 59 |
| 711 | -700438102 | 700438102H1 | SATMON026 | g945086 | BLASTN | 205 | 1e-16 | 78 |
| 712 | -700438243 | 700438243H1 | SATMON026 | g290057 | BLASTN | 107 | 1e-29 | 90 |
| 713 | -700439444 | 700439444H1 | SATMON026 | g2062176 | BLASTN | 253 | 1e-37 | 72 |
| 714 | -700441743 | 700441743H1 | SATMON026 | g2398533 | BLASTN | 92 | 1e-39 | 76 |
| 715 | -700445068 | 700445068H1 | SATMON027 | g2245059 | BLASTN | 248 | 1e-38 | 66 |
| 716 | -700445278 | 700445278H1 | SATMON027 | g1658504 | BLASTN | 128 | 1e-19 | 58 |
| 717 | -700445763 | 700445763H1 | SATMON027 | g2623247 | BLASTN | 375 | 1e-20 | 94 |
| 718 | -700450354 | 700450354H1 | SATMON028 | g1946266 | BLASTN | 450 | 1e-27 | 74 |
| 719 | -700450456 | 700450456H1 | SATMON028 | g939784 | BLASTN | 307 | 1e-14 | 91 |
| 720 | -700450661 | 700450661H1 | SATMON028 | g22379 | BLASTN | 344 | 1e-19 | 82 |
| 721 | -700452911 | 700452911H1 | SATMON028 | g19490 | BLASTN | 114 | 1e-17 | 50 |
| 722 | -700454133 | 700454133H1 | SATMON029 | g497895 | BLASTN | 145 | 1e-21 | 69 |
| 723 | -700455972 | 700455972H1 | SATMON029 | g1109830 | BLASTN | 148 | 1e-22 | 45 |
| 724 | -700456486 | 700456486H1 | SATMON029 | g662931 | BLASTN | 442 | 1e-26 | 72 |
| 725 | -700457355 | 700457355H1 | SATMON029 | g2997755 | BLASTN | 155 | 1e-23 | 53 |
| 726 | -700458137 | 700458137H1 | SATMON029 | g556557 | BLASTN | 222 | 1e-40 | 89 |
| 727 | -700468802 | 700468802H1 | SATMON025 | g2104683 | BLASTN | 92 | 1e-20 | 42 |
| 728 | -700471323 | 700471323H1 | SATMON025 | g2264318 | BLASTN | 362 | 1e-19 | 77 |
| 729 | -700474747 | 700474747H1 | SATMON025 | g2735839 | BLASTN | 711 | 1e-72 | 93 |
| 730 | -700475624 | 700475624H1 | SATMON025 | g2245390 | BLASTN | 104 | 1e-33 | 71 |
| 731 | -700476829 | 700476829H1 | SATMON025 | g712839 | BLASTN | 102 | 1e-17 | 50 |
| 732 | -700477049 | 700477049H1 | SATMON025 | g1109830 | BLASTN | 191 | 1e-38 | 59 |
| 733 | -700479575 | 700479575H1 | SATMON034 | g19260 | BLASTN | 122 | 1e-18 | 54 |
| 734 | -700550479 | 700550479H1 | SATMON022 | g2257568 | BLASTN | 200 | 1e-29 | 51 |
| 735 | -700551414 | 700551414H1 | SATMON022 | g2245390 | BLASTN | 109 | 1e-25 | 57 |
| 736 | -700551996 | 700551996H1 | SATMON022 | g2735839 | BLASTN | 969 | 1e-82 | 89 |
| 737 | -700570447 | 700570447H1 | SATMON030 | g1334687 | BLASTN | 112 | 1e-23 | 42 |
| 738 | -700573073 | 700573073H1 | SATMON030 | g2104679 | BLASTN | 140 | 1e-21 | 53 |
| 739 | -700574093 | 700574093H1 | SATMON030 | g786426 | BLASTN | 136 | 1e-29 | 66 |
| 740 | -700574149 | 700574149H1 | SATMON030 | g786426 | BLASTN | 249 | 1e-36 | 77 |
| 741 | -700574493 | 700574493H1 | SATMON030 | g1666172 | BLASTN | 667 | 1e-46 | 76 |
| 742 | -700576385 | 700576385H1 | SATMON030 | g2062176 | BLASTN | 91 | 1e-20 | 46 |
| 743 | -700576923 | 700576923H1 | SATMON030 | g2094855 | BLASTN | 435 | 1e-27 | 66 |
| 744 | -700577328 | 700577328H1 | SATMON031 | g1732512 | BLASTN | 474 | 1e-29 | 68 |
| 745 | -700578519 | 700578519H1 | SATMON031 | g2460124 | BLASTN | 80 | 1e-18 | 44 |
| 746 | -700581676 | 700581676H1 | SATMON031 | g2104678 | BLASTN | 604 | 1e-41 | 72 |
| 747 | -700611554 | 700611554H1 | SATMON022 | g19492 | BLASTN | 133 | 1e-24 | 86 |
| 748 | -700613059 | 700613059H1 | SATMON033 | g2623247 | BLASTN | 282 | 1e-28 | 91 |
| 749 | -700613368 | 700613368H1 | SATMON033 | g1244707 | BLASTN | 252 | 1e-12 | 67 |
| 750 | -700616291 | 700616291H1 | SATMON033 | g2791686 | BLASTN | 94 | 1e-31 | 75 |
| 751 | -700616301 | 700616301H1 | SATMON033 | g500716 | BLASTN | 88 | 1e-21 | 40 |
| 752 | -700618172 | 700618172H1 | SATMON033 | g2826884 | BLASTN | 92 | 1e-20 | 65 |
| 753 | -700621627 | 700621627H1 | SATMON034 | g928940 | BLASTN | 261 | 1e-29 | 79 |
| 754 | -700622876 | 700622876H1 | SATMON034 | g556558 | BLASTN | 85 | 1e-18 | 73 |
| 755 | -700801070 | 700801070H1 | SATMON036 | g1232130 | BLASTN | 184 | 1e-34 | 67 |
| 756 | -700801770 | 700801770H1 | SATMON036 | g2735839 | BLASTN | 610 | 1e-77 | 89 |
| 757 | -700805033 | 700805033H1 | SATMON036 | g2245059 | BLASTN | 222 | 1e-34 | 71 |
| 758 | -700807208 | 700807208H1 | SATMON036 | g940880 | BLASTN | 249 | 1e-09 | 66 |
| 759 | -701158984 | 701158984H2 | SATMONN04 | g2245390 | BLASTN | 117 | 1e-18 | 79 |
| 760 | -701160396 | 701160396H1 | SATMONN04 | g1017722 | BLASTN | 137 | 1e-20 | 39 |
| 761 | -701162944 | 701162944H1 | SATMONN04 | g2104680 | BLASTN | 322 | 1e-16 | 76 |
| 762 | -701163605 | 701163605H1 | SATMONN04 | g945087 | BLASTN | 118 | 1e-18 | 74 |
| 763 | -701163909 | 701163909H1 | SATMONN04 | g945087 | BLASTN | 106 | 1e-26 | 74 |
| 764 | -701164109 | 701164109H1 | SATMONN04 | g945087 | BLASTN | 181 | 1e-27 | 69 |
| 765 | -701166305 | 701166305H1 | SATMONN04 | g791053 | BLASTN | 120 | 1e-19 | 68 |
| 766 | -701166764 | 701166764H1 | SATMONN04 | g786426 | BLASTN | 89 | 1e-17 | 59 |
| 767 | -701166991 | 701166991H1 | SATMONN04 | g786426 | BLASTN | 81 | 1e-19 | 43 |
| 768 | -701167666 | 701167666H1 | SATMONN05 | g2735839 | BLASTN | 322 | 1e-16 | 60 |
| 769 | -701169152 | 701169152H1 | SATMONN05 | g1838975 | BLASTN | 442 | 1e-26 | 69 |
| 770 | -701176332 | 701176332H1 | SATMONN05 | g2865393 | BLASTN | 893 | 1e-98 | 95 |
| 771 | -701176532 | 701176532H1 | SATMONN05 | g1946266 | BLASTN | 596 | 1e-40 | 73 |
| 772 | -701177470 | 701177470H1 | SATMONN05 | g786426 | BLASTN | 160 | 1e-33 | 72 |
| 773 | -701178415 | 701178415H1 | SATMONN05 | g1663706 | BLASTN | 119 | 1e-18 | 45 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 774 | -701181844 | 701181844H1 | SATMONN06 | g309567 | BLASTN | 261 | 1e-17 | 73 |
| 775 | -701182022 | 701182022H1 | SATMONN06 | g2735839 | BLASTN | 804 | 1e-73 | 94 |
| 776 | 10841 | 700354175H1 | SATMON024 | g886400 | BLASTN | 608 | 1e-41 | 85 |
| 777 | 11048 | 700091161H1 | SATMON011 | g22379 | BLASTN | 815 | 1e-118 | 99 |
| 778 | 11048 | 700094225H1 | SATMON008 | g22379 | BLASTN | 1254 | 1e-96 | 94 |
| 779 | 11048 | LIB3066-048-Q1-K1-B3 | LIB3066 | g22379 | BLASTN | 1336 | 1e-140 | 96 |
| 780 | 1132 | 700016293H1 | SATMON001 | g2104681 | BLASTN | 149 | 1e-21 | 72 |
| 781 | 1132 | 700030344H1 | SATMON003 | g2104681 | BLASTN | 149 | 1e-22 | 72 |
| 782 | 1132 | 700044121H1 | SATMON004 | g2245037 | BLASTN | 80 | 1e-20 | 80 |
| 783 | 1132 | 700074952H1 | SATMON007 | g2104680 | BLASTN | 261 | 1e-10 | 67 |
| 784 | 1132 | 700083435H1 | SATMON011 | g2104681 | BLASTN | 178 | 1e-31 | 69 |
| 785 | 1132 | 700086305H1 | SATMON011 | g2104681 | BLASTN | 149 | 1e-21 | 72 |
| 786 | 1132 | 700086644H1 | SATMON011 | g2245037 | BLASTN | 82 | 1e-20 | 78 |
| 787 | 1132 | 700086711H1 | SATMON011 | g2104681 | BLASTN | 103 | 1e-21 | 68 |
| 788 | 1132 | 700087425H1 | SATMON011 | g2104681 | BLASTN | 149 | 1e-22 | 72 |
| 789 | 1132 | 700090989H1 | SATMON011 | g2104681 | BLASTN | 116 | 1e-17 | 75 |
| 790 | 1132 | 700154203H1 | SATMON007 | g2245037 | BLASTN | 117 | 1e-19 | 62 |
| 791 | 1132 | 700154842H1 | SATMON007 | g2104681 | BLASTN | 116 | 1e-19 | 72 |
| 792 | 1132 | 700158381H1 | SATMON012 | g2104681 | BLASTN | 105 | 1e-18 | 69 |
| 793 | 1132 | 700202205H1 | SATMON003 | g2104681 | BLASTN | 133 | 1e-26 | 55 |
| 794 | 1132 | 700212439H1 | SATMON016 | g2104681 | BLASTN | 157 | 1e-22 | 73 |
| 795 | 1132 | 700214363H1 | SATMON016 | g2104681 | BLASTN | 149 | 1e-21 | 72 |
| 796 | 1132 | 700218135H1 | SATMON016 | g2104681 | BLASTN | 99 | 1e-21 | 71 |
| 797 | 1132 | 700218926H1 | SATMON011 | g2104681 | BLASTN | 176 | 1e-30 | 68 |
| 798 | 1132 | 700218975H1 | SATMON011 | g2104680 | BLASTN | 256 | 1e-12 | 70 |
| 799 | 1132 | 700220843H1 | SATMON011 | g2104681 | BLASTN | 149 | 1e-21 | 72 |
| 800 | 1132 | 700332959H1 | SATMON019 | g2104681 | BLASTN | 162 | 1e-27 | 65 |
| 801 | 1132 | 700341508H1 | SATMON020 | g2104681 | BLASTN | 104 | 1e-21 | 72 |
| 802 | 1132 | 700342724H1 | SATMON021 | g2104681 | BLASTN | 99 | 1e-21 | 71 |
| 803 | 1132 | 700379133H1 | SATMON020 | g2104681 | BLASTN | 181 | 1e-27 | 67 |
| 804 | 1132 | 700379623H1 | SATMON021 | g2104681 | BLASTN | 204 | 1e-35 | 68 |
| 805 | 1132 | 700381233H1 | SATMON023 | g2104681 | BLASTN | 178 | 1e-30 | 68 |
| 806 | 1132 | 700428163H1 | SATMONN01 | g2104681 | BLASTN | 158 | 1e-28 | 56 |
| 807 | 1132 | 700550895H1 | SATMON022 | g2104681 | BLASTN | 149 | 1e-21 | 72 |
| 808 | 1132 | 700571669H1 | SATMON030 | g2104680 | BLASTN | 243 | 1e-09 | 68 |
| 809 | 1132 | 701172936H2 | SATMONN05 | g2104680 | BLASTN | 286 | 1e-12 | 62 |
| 810 | 1132 | LIB143-012-Q1-E1-C3 | LIB143 | g2104681 | BLASTN | 149 | 1e-37 | 72 |
| 811 | 1132 | LIB143-040-Q1-E1-H12 | LIB143 | g2104681 | BLASTN | 161 | 1e-45 | 70 |
| 812 | 1132 | LIB143-051-Q1-E1-F1 | LIB143 | g2104681 | BLASTN | 94 | 1e-44 | 68 |
| 813 | 1132 | LIB3059-053-Q1-K1-C9 | LIB3059 | g2104680 | BLASTN | 255 | 1e-17 | 76 |
| 814 | 1132 | LIB84-017-Q1-E1-A12 | LIB84 | g2104681 | BLASTN | 143 | 1e-37 | 70 |
| 815 | 11643 | 700150626H1 | SATMON007 | g556408 | BLASTN | 520 | 1e-34 | 74 |
| 816 | 11643 | 700379992H1 | SATMON021 | g556409 | BLASTN | 96 | 1e-21 | 60 |
| 817 | 11643 | 700447471H1 | SATMON027 | g556409 | BLASTN | 221 | 1e-37 | 79 |
| 818 | 11643 | 700578312H1 | SATMON031 | g556409 | BLASTN | 201 | 1e-31 | 85 |
| 819 | 11643 | 700578412H1 | SATMON031 | g556409 | BLASTN | 190 | 1e-31 | 85 |
| 820 | 11643 | 700579885H1 | SATMON031 | g556409 | BLASTN | 182 | 1e-32 | 71 |
| 821 | 11643 | LIB3078-052-Q1-K1-G4 | LIB3078 | g556408 | BLASTN | 456 | 1e-26 | 71 |
| 822 | 11816 | 700153106H1 | SATMON007 | g458966 | BLASTN | 192 | 1e-28 | 80 |
| 823 | 11816 | LIB3060-035-Q1-K1-C12 | LIB3060 | g458966 | BLASTN | 374 | 1e-72 | 57 |
| 824 | 11817 | 700082505H1 | SATMON011 | g2735839 | BLASTN | 577 | 1e-64 | 87 |
| 825 | 11817 | 700804825H1 | SATMON036 | g2735839 | BLASTN | 437 | 1e-33 | 96 |
| 826 | 11817 | 701186081H1 | SATMONN06 | g2735839 | BLASTN | 993 | 1e-83 | 96 |
| 827 | 11817 | LIB3062-043-Q1-K1-C6 | LIB3062 | g2735839 | BLASTN | 971 | 1e-147 | 95 |
| 828 | 11912 | 700029540H1 | SATMON003 | g945086 | BLASTN | 385 | 1e-47 | 86 |
| 829 | 11912 | 700088190H1 | SATMON011 | g945086 | BLASTN | 638 | 1e-44 | 85 |
| 830 | 11912 | 700202293H1 | SATMON003 | g945087 | BLASTN | 162 | 1e-24 | 75 |
| 831 | 11912 | 700238151H1 | SATMON010 | g945086 | BLASTN | 259 | 1e-10 | 81 |
| 832 | 11912 | 700333803H1 | SATMON019 | g945086 | BLASTN | 276 | 1e-28 | 80 |
| 833 | 11912 | 700349774H1 | SATMON023 | g945086 | BLASTN | 635 | 1e-44 | 85 |
| 834 | 11912 | 700622017H1 | SATMON034 | g945086 | BLASTN | 499 | 1e-38 | 85 |
| 835 | 11912 | 700622588H1 | SATMON034 | g945086 | BLASTN | 776 | 1e-59 | 84 |
| 836 | 11912 | 700799161H1 | SATMON036 | g945086 | BLASTN | 486 | 1e-40 | 84 |
| 837 | 11964 | LIB83-016-Q1-E1-E1 | LIB83 | g2961085 | BLASTN | 248 | 1e-52 | 48 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 838 | 12088 | 700089512H1 | SATMON011 | g2826884 | BLASTN | 94 | 1e−22 | 56 |
| 839 | 12088 | 700467762H1 | SATMON025 | g2826884 | BLASTN | 94 | 1e−22 | 56 |
| 840 | 12088 | 700469512H1 | SATMON025 | g2826884 | BLASTN | 86 | 1e−20 | 50 |
| 841 | 12088 | LIB3067-001-Q1-K1-D2 | LIB3067 | g1429226 | BLASTN | 69 | 1e−33 | 55 |
| 842 | 1213 | 700331889H1 | SATMON019 | g291504 | BLASTN | 44 | 1e−17 | 47 |
| 843 | 12161 | 700168246H1 | SATMON025 | g2145358 | BLASTN | 291 | 1e−42 | 72 |
| 844 | 12374 | 700171613H1 | SATMON013 | g2894561 | BLASTN | 212 | 1e−33 | 69 |
| 845 | 12374 | 700171646H1 | SATMON013 | g2894563 | BLASTN | 209 | 1e−32 | 64 |
| 846 | 12374 | 700441607H1 | SATMON026 | g2894563 | BLASTN | 211 | 1e−33 | 55 |
| 847 | 12389 | 700345009H1 | SATMON021 | g1905933 | BLASTN | 698 | 1e−49 | 84 |
| 848 | 12389 | 700345457H1 | SATMON021 | g939780 | BLASTN | 321 | 1e−38 | 86 |
| 849 | 12389 | 700347055H1 | SATMON021 | g939784 | BLASTN | 714 | 1e−50 | 85 |
| 850 | 12389 | 700452517H1 | SATMON028 | g939784 | BLASTN | 731 | 1e−52 | 83 |
| 851 | 12389 | 700468216H1 | SATMON025 | g939780 | BLASTN | 558 | 1e−37 | 83 |
| 852 | 12389 | 700552743H1 | SATMON022 | g939784 | BLASTN | 656 | 1e−45 | 86 |
| 853 | 12389 | LIB3062-026-Q1-K1-F3 | LIB3062 | g939780 | BLASTN | 308 | 1e−32 | 85 |
| 854 | 12389 | LIB3069-036-Q1-K1-H9 | LIB3069 | g1905943 | BLASTN | 289 | 1e−13 | 76 |
| 855 | 1281 | 700438124H1 | SATMON026 | g791055 | BLASTN | 131 | 1e−24 | 41 |
| 856 | 1281 | 700438323H1 | SATMON026 | g1345437 | BLASTN | 70 | 1e−18 | 51 |
| 857 | 1281 | 700438324H1 | SATMON026 | g1345404 | BLASTN | 120 | 1e−21 | 46 |
| 858 | 13064 | 700220312H1 | SATMON011 | g2511745 | BLASTN | 174 | 1e−31 | 59 |
| 859 | 13064 | 700476055H1 | SATMON025 | g2511745 | BLASTN | 165 | 1e−24 | 58 |
| 860 | 13159 | 700215689H1 | SATMON016 | g2921823 | BLASTN | 196 | 1e−28 | 73 |
| 861 | 13159 | 700222611H1 | SATMON011 | g2921823 | BLASTN | 180 | 1e−26 | 70 |
| 862 | 13506 | 700258514H1 | SATMON017 | g458966 | BLASTN | 124 | 1e−18 | 59 |
| 863 | 13506 | 700550058H1 | SATMON022 | g458966 | BLASTN | 167 | 1e−31 | 55 |
| 864 | 13583 | 700240501H1 | SATMON010 | g2160155 | BLASTN | 280 | 1e−24 | 66 |
| 865 | 13583 | 700334013H1 | SATMON019 | g1747309 | BLASTN | 304 | 1e−35 | 68 |
| 866 | 13583 | 700464860H1 | SATMON025 | g2160155 | BLASTN | 247 | 1e−18 | 74 |
| 867 | 13719 | 700019216H1 | SATMON001 | g1666172 | BLASTN | 457 | 1e−29 | 78 |
| 868 | 13719 | 700027811H1 | SATMON003 | g1666172 | BLASTN | 631 | 1e−43 | 76 |
| 869 | 13719 | 700085319H1 | SATMON011 | g1666172 | BLASTN | 827 | 1e−60 | 77 |
| 870 | 13719 | 700091978H1 | SATMON011 | g1666172 | BLASTN | 776 | 1e−56 | 76 |
| 871 | 13719 | 700105364H1 | SATMON010 | g1666172 | BLASTN | 763 | 1e−55 | 76 |
| 872 | 13719 | 700164474H1 | SATMON013 | g1666172 | BLASTN | 465 | 1e−30 | 77 |
| 873 | 13719 | 700169668H1 | SATMON013 | g1666172 | BLASTN | 421 | 1e−25 | 77 |
| 874 | 13719 | 700205083H1 | SATMON003 | g1666172 | BLASTN | 732 | 1e−52 | 72 |
| 875 | 13719 | 700217819H1 | SATMON016 | g1666172 | BLASTN | 580 | 1e−39 | 78 |
| 876 | 13719 | 700261364H1 | SATMON017 | g1666172 | BLASTN | 596 | 1e−41 | 78 |
| 877 | 13719 | 700337547H1 | SATMON020 | g1666172 | BLASTN | 637 | 1e−44 | 77 |
| 878 | 13719 | 700351584H1 | SATMON023 | g1666173 | BLASTN | 136 | 1e−21 | 89 |
| 879 | 13719 | 700456150H1 | SATMON029 | g1666172 | BLASTN | 315 | 1e−20 | 78 |
| 880 | 13719 | 700569667H1 | SATMON030 | g2982299 | BLASTN | 127 | 1e−20 | 50 |
| 881 | 13719 | 700617352H1 | SATMON033 | g2982299 | BLASTN | 190 | 1e−29 | 78 |
| 882 | 13719 | 700619290H1 | SATMON034 | g1666172 | BLASTN | 414 | 1e−23 | 76 |
| 883 | 13719 | 700621490H1 | SATMON034 | g1666172 | BLASTN | 805 | 1e−58 | 78 |
| 884 | 13719 | 700703945H1 | SATMON036 | g2982299 | BLASTN | 190 | 1e−29 | 78 |
| 885 | 13719 | LIB143-003-Q1-E1-F9 | LIB143 | g2982299 | BLASTN | 244 | 1e−53 | 65 |
| 886 | 13719 | LIB3068-006-Q1-K1-C8 | LIB3068 | g1666172 | BLASTN | 787 | 1e−57 | 72 |
| 887 | 13719 | LIB36-022-Q1-E1-A4 | LIB36 | g1666172 | BLASTN | 778 | 1e−55 | 72 |
| 888 | 1376 | 700020470H1 | SATMON001 | g1666172 | BLASTN | 320 | 1e−17 | 77 |
| 889 | 1376 | 700025761H1 | SATMON003 | g1666172 | BLASTN | 507 | 1e−33 | 76 |
| 890 | 1376 | 700028245H1 | SATMON003 | g2982298 | BLASTN | 717 | 1e−51 | 78 |
| 891 | 1376 | 700043653H1 | SATMON004 | g1666172 | BLASTN | 701 | 1e−49 | 80 |
| 892 | 1376 | 700046208H1 | SATMON004 | g1666172 | BLASTN | 476 | 1e−30 | 79 |
| 893 | 1376 | 700072365H1 | SATMON007 | g1666172 | BLASTN | 629 | 1e−43 | 80 |
| 894 | 1376 | 700075933H1 | SATMON007 | g1666172 | BLASTN | 645 | 1e−45 | 78 |
| 895 | 1376 | 700084617H1 | SATMON011 | g2982298 | BLASTN | 610 | 1e−46 | 76 |
| 896 | 1376 | 700092634H1 | SATMON008 | g1666172 | BLASTN | 835 | 1e−61 | 79 |
| 897 | 1376 | 700092836H1 | SATMON008 | g1666172 | BLASTN | 863 | 1e−63 | 79 |
| 898 | 1376 | 700092927H1 | SATMON008 | g1666172 | BLASTN | 909 | 1e−67 | 79 |
| 899 | 1376 | 700094657H1 | SATMON008 | g1666172 | BLASTN | 771 | 1e−55 | 80 |
| 900 | 1376 | 700096443H1 | SATMON008 | g1666172 | BLASTN | 493 | 1e−32 | 81 |
| 901 | 1376 | 700098804H1 | SATMON009 | g1666172 | BLASTN | 715 | 1e−51 | 76 |
| 902 | 1376 | 700100004H1 | SATMON009 | g1666172 | BLASTN | 692 | 1e−49 | 78 |
| 903 | 1376 | 700102738H1 | SATMON010 | g2982298 | BLASTN | 598 | 1e−41 | 74 |
| 904 | 1376 | 700157167H1 | SATMON012 | g2982298 | BLASTN | 374 | 1e−25 | 72 |
| 905 | 1376 | 700160622H1 | SATMON012 | g1666172 | BLASTN | 647 | 1e−45 | 76 |

-continued

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 906 | 1376 | 700160771H1 | SATMON012 | g2982298 | BLASTN | 649 | 1e-45 | 76 |
| 907 | 1376 | 700167008H1 | SATMON013 | g2982298 | BLASTN | 534 | 1e-35 | 73 |
| 908 | 1376 | 700167594H1 | SATMON013 | g1666172 | BLASTN | 501 | 1e-33 | 78 |
| 909 | 1376 | 700202914H1 | SATMON003 | g1666172 | BLASTN | 165 | 1e-08 | 79 |
| 910 | 1376 | 700205538H1 | SATMON003 | g1666172 | BLASTN | 658 | 1e-46 | 76 |
| 911 | 1376 | 700206442H1 | SATMON003 | g1666172 | BLASTN | 364 | 1e-19 | 70 |
| 912 | 1376 | 700207388H1 | SATMON016 | g1666172 | BLASTN | 480 | 1e-31 | 77 |
| 913 | 1376 | 700208716H1 | SATMON016 | g1666172 | BLASTN | 629 | 1e-43 | 80 |
| 914 | 1376 | 700212157H1 | SATMON016 | g1666172 | BLASTN | 374 | 1e-26 | 81 |
| 915 | 1376 | 700215562H1 | SATMON016 | g1666172 | BLASTN | 629 | 1e-43 | 80 |
| 916 | 1376 | 700216355H1 | SATMON016 | g1666172 | BLASTN | 609 | 1e-42 | 79 |
| 917 | 1376 | 700221834H1 | SATMON011 | g2982298 | BLASTN | 445 | 1e-31 | 72 |
| 918 | 1376 | 700224896H1 | SATMON011 | g2982299 | BLASTN | 166 | 1e-37 | 84 |
| 919 | 1376 | 700244238H1 | SATMON010 | g1666172 | BLASTN | 546 | 1e-36 | 79 |
| 920 | 1376 | 700332668H1 | SATMON019 | g1666172 | BLASTN | 682 | 1e-48 | 75 |
| 921 | 1376 | 700342661H1 | SATMON021 | g1666172 | BLASTN | 573 | 1e-39 | 81 |
| 922 | 1376 | 700353090H1 | SATMON024 | g1666172 | BLASTN | 507 | 1e-33 | 79 |
| 923 | 1376 | 700380279H1 | SATMON021 | g1666172 | BLASTN | 873 | 1e-64 | 78 |
| 924 | 1376 | 700451362H1 | SATMON028 | g1666172 | BLASTN | 247 | 1e-10 | 73 |
| 925 | 1376 | 700456437H1 | SATMON029 | g2982298 | BLASTN | 406 | 1e-31 | 76 |
| 926 | 1376 | 700475487H1 | SATMON025 | g2982298 | BLASTN | 590 | 1e-40 | 72 |
| 927 | 1376 | 700549437H1 | SATMON022 | g1666172 | BLASTN | 736 | 1e-52 | 78 |
| 928 | 1376 | 700575656H1 | SATMON030 | g1666172 | BLASTN | 721 | 1e-51 | 75 |
| 929 | 1376 | 700576835H1 | SATMON031 | g1666172 | BLASTN | 608 | 1e-42 | 76 |
| 930 | 1376 | 700613990H1 | SATMON033 | g1666172 | BLASTN | 314 | 1e-28 | 75 |
| 931 | 1376 | 700805417H1 | SATMON036 | g1666172 | BLASTN | 642 | 1e-50 | 80 |
| 932 | 1376 | 701158424H1 | SATMONN04 | g1666173 | BLASTN | 124 | 1e-23 | 91 |
| 933 | 1376 | LIB143-061-Q1-E1-G4 | LIB143 | g1666172 | BLASTN | 522 | 1e-45 | 80 |
| 934 | 1376 | LIB143-059-Q1-E1-F6 | LIB143 | g1666172 | BLASTN | 748 | 1e-53 | 79 |
| 935 | 1376 | LIB3060-023-Q1-K1-F3 | LIB3060 | g1666172 | BLASTN | 252 | 1e-17 | 72 |
| 936 | 1376 | LIB3061-005-Q1-K1-G1 | LIB3061 | g1666172 | BLASTN | 647 | 1e-52 | 77 |
| 937 | 1376 | LIB3062-011-Q1-K1-F6 | LIB3062 | g2982298 | BLASTN | 472 | 1e-28 | 69 |
| 938 | 1376 | LIB3067-018-Q1-K1-E5 | LIB3067 | g1666172 | BLASTN | 671 | 1e-45 | 77 |
| 939 | 1376 | LIB3079-001-Q1-K1-E12 | LIB3079 | g1666172 | BLASTN | 902 | 1e-66 | 79 |
| 940 | 1376 | LIB3079-019-Q1-K1-B12 | LIB3079 | g1666172 | BLASTN | 704 | 1e-48 | 79 |
| 941 | 1376 | LIB36-009-Q1-E1-H8 | LIB36 | g1666172 | BLASTN | 786 | 1e-56 | 78 |
| 942 | 13817 | 700156366H1 | SATMON007 | g1244508 | BLASTN | 166 | 1e-24 | 49 |
| 943 | 13819 | 700208518H1 | SATMON016 | g19388 | BLASTN | 108 | 1e-24 | 76 |
| 944 | 13819 | 700210071H1 | SATMON016 | g939784 | BLASTN | 471 | 1e-30 | 82 |
| 945 | 13819 | LIB3062-002-Q1-K2-B3 | LIB3062 | g939780 | BLASTN | 645 | 1e-42 | 83 |
| 946 | 13890 | 700282376H2 | SATMON023 | g1905943 | BLASTN | 407 | 1e-45 | 93 |
| 947 | 13890 | 700282564H2 | SATMON024 | g1905943 | BLASTN | 500 | 1e-49 | 96 |
| 948 | 13890 | 700349716H1 | SATMON023 | g939780 | BLASTN | 429 | 1e-25 | 76 |
| 949 | 13890 | LIB3059-018-Q1-K1-B7 | LIB3059 | g2463332 | BLASTN | 1071 | 1e-80 | 82 |
| 950 | 13890 | LIB3067-037-Q1-K1-G5 | LIB3067 | g2286110 | BLASTN | 523 | 1e-68 | 83 |
| 951 | 13890 | LIB3079-013-Q1-K1-A1 | LIB3079 | g1905929 | BLASTN | 1150 | 1e-87 | 86 |
| 952 | 13934 | 700351915H1 | SATMON023 | g2344890 | BLASTN | 105 | 1e-20 | 68 |
| 953 | 14414 | 700082817H1 | SATMON011 | g945086 | BLASTN | 487 | 1e-30 | 83 |
| 954 | 14414 | 700618843H1 | SATMON034 | g945086 | BLASTN | 237 | 1e-08 | 85 |
| 955 | 14956 | 700150716H1 | SATMON007 | g556557 | BLASTN | 414 | 1e-37 | 73 |
| 956 | 14956 | 700333140H1 | SATMON019 | g556557 | BLASTN | 587 | 1e-52 | 73 |
| 957 | 14956 | 700450804H1 | SATMON028 | g556557 | BLASTN | 824 | 1e-59 | 86 |
| 958 | 14956 | LIB3060-042-Q1-K1-D12 | LIB3060 | g556557 | BLASTN | 547 | 1e-65 | 76 |
| 959 | 15036 | 700104914H1 | SATMON010 | g22379 | BLASTN | 412 | 1e-61 | 77 |
| 960 | 15036 | 700171706H1 | SATMON013 | g22379 | BLASTN | 431 | 1e-43 | 85 |
| 961 | 15077 | 700026485H1 | SATMON003 | g22379 | BLASTN | 594 | 1e-62 | 81 |
| 962 | 15077 | 700104944H1 | SATMON010 | g22379 | BLASTN | 807 | 1e-58 | 73 |
| 963 | 15077 | 700549355H1 | SATMON022 | g22379 | BLASTN | 755 | 1e-54 | 72 |
| 964 | 15077 | 700807317H1 | SATMON036 | g22379 | BLASTN | 217 | 1e-19 | 69 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 965 | 15077 | LIB3078-050-Q1-K1-C8 | LIB3078 | g22379 | BLASTN | 1128 | 1e−85 | 81 |
| 966 | 15172 | 700470605H1 | SATMON025 | g2104679 | BLASTN | 60 | 1e−18 | 85 |
| 967 | 15338 | 700343807H1 | SATMON021 | g945086 | BLASTN | 849 | 1e−62 | 76 |
| 968 | 15338 | 700346108H1 | SATMON021 | g945086 | BLASTN | 561 | 1e−37 | 73 |
| 969 | 15338 | 700452502H1 | SATMON028 | g945086 | BLASTN | 806 | 1e−58 | 74 |
| 970 | 15338 | 700571956H1 | SATMON030 | g945086 | BLASTN | 691 | 1e−48 | 77 |
| 971 | 15338 | LIB148-040-Q1-E1-E12 | LIB148 | g945086 | BLASTN | 570 | 1e−38 | 78 |
| 972 | 15438 | 700569108H1 | SATMON030 | g1946264 | BLASTN | 508 | 1e−32 | 71 |
| 973 | 15611 | 700163842H1 | SATMON013 | g2735763 | BLASTN | 410 | 1e−24 | 69 |
| 974 | 15611 | 700167876H1 | SATMON013 | g2735763 | BLASTN | 411 | 1e−24 | 64 |
| 975 | 15611 | 700168569H1 | SATMON013 | g2735763 | BLASTN | 376 | 1e−21 | 63 |
| 976 | 15611 | 700457705H1 | SATMON029 | g2735763 | BLASTN | 384 | 1e−21 | 62 |
| 977 | 15611 | 701162752H1 | SATMONN04 | g2735764 | BLASTN | 164 | 1e−28 | 53 |
| 978 | 15611 | LIB189-005-Q1-E1-H10 | LIB189 | g2735763 | BLASTN | 713 | 1e−49 | 64 |
| 979 | 15611 | LIB189-022-Q1-E1-A9 | LIB189 | g2735763 | BLASTN | 768 | 1e−53 | 65 |
| 980 | 15955 | 700201303H1 | SATMON003 | g2385410 | BLASTN | 139 | 1e−21 | 31 |
| 981 | 15955 | 700219090H1 | SATMON011 | g2385410 | BLASTN | 186 | 1e−27 | 33 |
| 982 | 15960 | 700217503H1 | SATMON016 | g2088643 | BLASTN | 178 | 1e−26 | 66 |
| 983 | 16670 | 700093202H1 | SATMON008 | g292498 | BLASTN | 170 | 1e−25 | 78 |
| 984 | 16806 | 700052180H1 | SATMON003 | g19050 | BLASTN | 490 | 1e−30 | 72 |
| 985 | 16806 | 700551696H1 | SATMON022 | g1732513 | BLASTN | 132 | 1e−20 | 76 |
| 986 | 16806 | 700575382H1 | SATMON030 | g19050 | BLASTN | 488 | 1e−30 | 69 |
| 987 | 16806 | LIB189-022-Q1-E1-G3 | LIB189 | g19050 | BLASTN | 486 | 1e−29 | 71 |
| 988 | 16823 | 700075006H1 | SATMON007 | g945086 | BLASTN | 162 | 1e−19 | 91 |
| 989 | 16823 | 700195166H1 | SATMON014 | g945086 | BLASTN | 598 | 1e−67 | 83 |
| 990 | 1685 | 700168578H1 | SATMON013 | g19050 | BLASTN | 914 | 1e−67 | 88 |
| 991 | 1685 | 700168586H1 | SATMON013 | g19050 | BLASTN | 600 | 1e−61 | 91 |
| 992 | 1685 | 700169008H1 | SATMON013 | g19051 | BLASTN | 114 | 1e−24 | 85 |
| 993 | 1685 | 700450735H1 | SATMON028 | g19050 | BLASTN | 516 | 1e−66 | 80 |
| 994 | 1685 | 700450862H1 | SATMON028 | g19050 | BLASTN | 782 | 1e−70 | 87 |
| 995 | 1685 | 701177241H1 | SATMONN05 | g19050 | BLASTN | 1098 | 1e−82 | 89 |
| 996 | 17026 | 700224747H1 | SATMON011 | g1109830 | BLASTN | 141 | 1e−21 | 49 |
| 997 | 17343 | 700162168H1 | SATMON012 | g2104680 | BLASTN | 312 | 1e−15 | 74 |
| 998 | 17343 | 700623376H1 | SATMON034 | g2104680 | BLASTN | 388 | 1e−21 | 73 |
| 999 | 1752 | 700094001H1 | SATMON008 | g2145358 | BLASTN | 267 | 1e−41 | 83 |
| 1000 | 1752 | 700166528H1 | SATMON013 | g2145358 | BLASTN | 162 | 1e−26 | 61 |
| 1001 | 1752 | 700472134H1 | SATMON025 | g2145358 | BLASTN | 147 | 1e−26 | 69 |
| 1002 | 1752 | 700550706H1 | SATMON022 | g2145358 | BLASTN | 206 | 1e−39 | 74 |
| 1003 | 17589 | 700453469H1 | SATMON028 | g1922964 | BLASTN | 199 | 1e−33 | 72 |
| 1004 | 17698 | 700170367H1 | SATMON013 | g19050 | BLASTN | 541 | 1e−47 | 87 |
| 1005 | 17698 | 700429674H1 | SATMONN01 | g19050 | BLASTN | 529 | 1e−63 | 89 |
| 1006 | 17844 | 700549177H1 | SATMON022 | g2245390 | BLASTN | 269 | 1e−39 | 63 |
| 1007 | 17844 | 700611553H1 | SATMON022 | g2245390 | BLASTN | 210 | 1e−30 | 67 |
| 1008 | 18145 | 700263654H1 | SATMON017 | g1107889 | BLASTN | 478 | 1e−29 | 61 |
| 1009 | 18464 | 700339475H1 | SATMON020 | g2735839 | BLASTN | 477 | 1e−44 | 76 |
| 1010 | 1870 | LIB189-032-Q1-E1-A3 | LIB189 | g431319 | BLASTN | 263 | 1e−56 | 78 |
| 1011 | 19066 | 700106876H1 | SATMON010 | g531901 | BLASTN | 146 | 1e−22 | 46 |
| 1012 | 19066 | 700424541H1 | SATMONN01 | g531899 | BLASTN | 99 | 1e−18 | 45 |
| 1013 | 19066 | 701163554H1 | SATMONN04 | g531897 | BLASTN | 151 | 1e−22 | 46 |
| 1014 | 19066 | 701177002H1 | SATMONN05 | g531897 | BLASTN | 148 | 1e−22 | 46 |
| 1015 | 19066 | LIB3067-010-Q1-K1-A8 | LIB3067 | g286023 | BLASTN | 151 | 1e−38 | 42 |
| 1016 | 19264 | 700466662H1 | SATMON025 | g2253581 | BLASTN | 139 | 1e−22 | 52 |
| 1017 | 19289 | 700427948H1 | SATMONN01 | g2443887 | BLASTN | 303 | 1e−43 | 70 |
| 1018 | 19289 | 700428162H1 | SATMONN01 | g2443887 | BLASTN | 102 | 1e−20 | 60 |
| 1019 | 19289 | 700428194H1 | SATMONN01 | g2443887 | BLASTN | 138 | 1e−30 | 57 |
| 1020 | 19406 | 700220084H1 | SATMON011 | g2435529 | BLASTN | 257 | 1e−37 | 55 |
| 1021 | 19898 | 700352780H1 | SATMON024 | g1890351 | BLASTN | 443 | 1e−26 | 68 |
| 1022 | 19898 | 700352862H1 | SATMON024 | g2088643 | BLASTN | 126 | 1e−19 | 64 |
| 1023 | 19898 | 700354483H1 | SATMON024 | g1890351 | BLASTN | 436 | 1e−25 | 66 |
| 1024 | 19898 | LIB148-018-Q1-E1-D2 | LIB148 | g1890351 | BLASTN | 541 | 1e−34 | 68 |
| 1025 | 19898 | LIB148-018-Q1-E1-B10 | LIB148 | g1890351 | BLASTN | 526 | 1e−32 | 67 |
| 1026 | 19898 | LIB148-010-Q1-E1-E3 | LIB148 | g1890351 | BLASTN | 537 | 1e−33 | 68 |
| 1027 | 19898 | LIB148-010-Q1-E1-B2 | LIB148 | g2088643 | BLASTN | 125 | 1e−54 | 64 |

-continued

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1028 | 19898 | LIB148-016-Q1-E1-A11 | LIB148 | g1890351 | BLASTN | 541 | 1e−34 | 68 |
| 1029 | 19898 | LIB148-011-Q1-E1-E4 | LIB148 | g1890351 | BLASTN | 469 | 1e−28 | 66 |
| 1030 | 19898 | LIB148-048-Q1-E1-F3 | LIB148 | g1890351 | BLASTN | 526 | 1e−32 | 67 |
| 1031 | 19898 | LIB148-048-Q1-E1-E4 | LIB148 | g1890351 | BLASTN | 501 | 1e−54 | 67 |
| 1032 | 19898 | LIB148-047-Q1-E1-B7 | LIB148 | g1890351 | BLASTN | 541 | 1e−34 | 68 |
| 1033 | 19898 | LIB148-024-Q1-E1-D11 | LIB148 | g1890351 | BLASTN | 541 | 1e−34 | 68 |
| 1034 | 19898 | LIB148-026-Q1-E1-C12 | LIB148 | g1890351 | BLASTN | 526 | 1e−33 | 67 |
| 1035 | 19898 | LIB148-037-Q1-E1-B6 | LIB148 | g1890351 | BLASTN | 541 | 1e−34 | 68 |
| 1036 | 19898 | LIB148-036-Q1-E1-D4 | LIB148 | g1890351 | BLASTN | 541 | 1e−34 | 68 |
| 1037 | 19898 | LIB148-041-Q1-E1-A7 | LIB148 | g1890351 | BLASTN | 503 | 1e−31 | 67 |
| 1038 | 19898 | LIB148-043-Q1-E1-D6 | LIB148 | g1890351 | BLASTN | 530 | 1e−33 | 67 |
| 1039 | 19898 | LIB148-028-Q1-E1-F5 | LIB148 | g1890351 | BLASTN | 541 | 1e−34 | 68 |
| 1040 | 19898 | LIB148-028-Q1-E1-B8 | LIB148 | g1890351 | BLASTN | 526 | 1e−32 | 67 |
| 1041 | 19898 | LIB148-065-Q1-E1-H11 | LIB148 | g1890351 | BLASTN | 526 | 1e−32 | 67 |
| 1042 | 19898 | LIB3066-007-Q1-K1-G6 | LIB3066 | g1890351 | BLASTN | 541 | 1e−34 | 68 |
| 1043 | 19898 | LIB3066-005-Q1-K1-A7 | LIB3066 | g1890351 | BLASTN | 541 | 1e−34 | 68 |
| 1044 | 19898 | LIB3066-043-Q1-K1-C2 | LIB3066 | g1890351 | BLASTN | 515 | 1e−31 | 69 |
| 1045 | 19898 | LIB3066-054-Q1-K1-H1 | LIB3066 | g1890351 | BLASTN | 501 | 1e−30 | 66 |
| 1046 | 19898 | LIB3066-020-Q1-K1-A12 | LIB3066 | g1890351 | BLASTN | 526 | 1e−32 | 67 |
| 1047 | 19898 | LIB3066-015-Q1-K1-C5 | LIB3066 | g1890351 | BLASTN | 541 | 1e−34 | 68 |
| 1048 | 19898 | LIB3066-018-Q1-K1-H6 | LIB3066 | g1890351 | BLASTN | 541 | 1e−34 | 68 |
| 1049 | 19898 | LIB3068-005-Q1-K1-F11 | LIB3068 | g1890351 | BLASTN | 443 | 1e−25 | 65 |
| 1050 | 19898 | LIB3068-044-Q1-K1-F11 | LIB3068 | g1890351 | BLASTN | 476 | 1e−39 | 68 |
| 1051 | 19898 | LIB3068-022-Q1-K1-G12 | LIB3068 | g1890351 | BLASTN | 443 | 1e−58 | 68 |
| 1052 | 19952 | 700223268H1 | SATMON011 | g2511745 | BLASTN | 76 | 1e−20 | 49 |
| 1053 | 19952 | 700263345H1 | SATMON017 | g2511745 | BLASTN | 112 | 1e−24 | 62 |
| 1054 | 19967 | 700209268H1 | SATMON016 | g1100994 | BLASTN | 124 | 1e−20 | 45 |
| 1055 | 19967 | 700349581H1 | SATMON023 | g893288 | BLASTN | 102 | 1e−20 | 56 |
| 1056 | 20005 | LIB84-003-Q1-E1-C7 | LIB84 | g171580 | BLASTN | 81 | 1e−35 | 47 |
| 1057 | 20026 | 700071863H1 | SATMON007 | g1747310 | BLASTN | 213 | 1e−39 | 76 |
| 1058 | 20026 | 700102802H1 | SATMON010 | g2160155 | BLASTN | 650 | 1e−45 | 70 |
| 1059 | 20079 | 700164569H1 | SATMON013 | g556557 | BLASTN | 1038 | 1e−77 | 92 |
| 1060 | 20079 | 700383195H1 | SATMON024 | g556557 | BLASTN | 616 | 1e−87 | 89 |
| 1061 | 20373 | 700087468H1 | SATMON011 | g556559 | BLASTN | 976 | 1e−76 | 82 |
| 1062 | 20373 | 700163648H1 | SATMON013 | g556559 | BLASTN | 867 | 1e−63 | 87 |
| 1063 | 20373 | 700204474H1 | SATMON003 | g556559 | BLASTN | 1007 | 1e−75 | 84 |
| 1064 | 20373 | 700223480H1 | SATMON011 | g556559 | BLASTN | 588 | 1e−40 | 83 |
| 1065 | 20373 | LIB3059-010-Q1-K1-H6 | LIB3059 | g556559 | BLASTN | 1007 | 1e−75 | 84 |
| 1066 | 20373 | LIB3078-034-Q1-K1-C10 | LIB3078 | g556559 | BLASTN | 1610 | 1e−125 | 86 |
| 1067 | 2043 | 700093173H1 | SATMON008 | g862650 | BLASTN | 121 | 1e−18 | 88 |
| 1068 | 2043 | 700336429H1 | SATMON019 | g862650 | BLASTN | 185 | 1e−27 | 85 |
| 1069 | 2043 | 701181431H1 | SATMONN06 | g862650 | BLASTN | 148 | 1e−22 | 84 |
| 1070 | 20899 | 700576709H1 | SATMON031 | g22192 | BLASTN | 261 | 1e−10 | 90 |
| 1071 | 21007 | 700352793H1 | SATMON024 | g1707639 | BLASTN | 1069 | 1e−80 | 92 |
| 1072 | 21007 | 700382758H1 | SATMON024 | g1707639 | BLASTN | 1182 | 1e−89 | 88 |
| 1073 | 21484 | 700030486H1 | SATMON003 | g662930 | BLASTN | 97 | 1e−25 | 67 |
| 1074 | 21484 | 700106455H1 | SATMON010 | g2245134 | BLASTN | 173 | 1e−34 | 65 |

-continued

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1075 | 21695 | 700473253H1 | SATMON025 | g2245390 | BLASTN | 254 | 1e-44 | 82 |
| 1076 | 21970 | 700100994H1 | SATMON009 | g289614 | BLASTN | 50 | 1e-17 | 50 |
| 1077 | 21996 | 700044342H1 | SATMON004 | g2398529 | BLASTN | 178 | 1e-27 | 74 |
| 1078 | 21996 | 700268080H1 | SATMON017 | g2398529 | BLASTN | 126 | 1e-19 | 60 |
| 1079 | 21996 | LIB83-005-Q1-E1-D9 | LIB83 | g22379 | BLASTN | 890 | 1e-65 | 84 |
| 1080 | 22061 | 700028446H1 | SATMON003 | g2735839 | BLASTN | 1017 | 1e-99 | 96 |
| 1081 | 22061 | 700196483H1 | SATMON014 | g2735839 | BLASTN | 572 | 1e-79 | 90 |
| 1082 | 22182 | 700802849H1 | SATMON036 | g456213 | BLASTN | 526 | 1e-34 | 79 |
| 1083 | 22296 | 700578393H1 | SATMON031 | g556559 | BLASTN | 802 | 1e-63 | 77 |
| 1084 | 22296 | 700578493H1 | SATMON031 | g556559 | BLASTN | 1004 | 1e-74 | 86 |
| 1085 | 22296 | LIB3059-047-Q1-K1-D8 | LIB3059 | g556559 | BLASTN | 1316 | 1e-100 | 81 |
| 1086 | 22296 | LIB3062-034-Q1-K1-H3 | LIB3062 | g556559 | BLASTN | 1257 | 1e-98 | 83 |
| 1087 | 22731 | 700094378H1 | SATMON008 | g556557 | BLASTN | 924 | 1e-68 | 86 |
| 1088 | 22731 | 700170710H1 | SATMON013 | g556557 | BLASTN | 847 | 1e-61 | 85 |
| 1089 | 22731 | 700578669H1 | SATMON031 | g556557 | BLASTN | 482 | 1e-43 | 82 |
| 1090 | 22731 | 700805287H1 | SATMON036 | g556557 | BLASTN | 774 | 1e-55 | 84 |
| 1091 | 22731 | 701158376H1 | SATMONN04 | g556557 | BLASTN | 695 | 1e-49 | 75 |
| 1092 | 22731 | LIB3060-049-Q1-K1-A9 | LIB3060 | g556557 | BLASTN | 1168 | 1e-88 | 76 |
| 1093 | 22731 | LIB3062-014-Q1-K1-A5 | LIB3062 | g556557 | BLASTN | 1167 | 1e-113 | 84 |
| 1094 | 22731 | LIB84-016-Q1-E1-B4 | LIB84 | g556557 | BLASTN | 1171 | 1e-88 | 82 |
| 1095 | 2297 | 700434680H1 | SATMONN01 | g2979566 | BLASTN | 167 | 1e-25 | 45 |
| 1096 | 2297 | 700451738H1 | SATMON028 | g862644 | BLASTN | 139 | 1e-21 | 52 |
| 1097 | 23228 | 701184022H1 | SATMONN06 | g172637 | BLASTN | 259 | 1e-11 | 75 |
| 1098 | 23328 | 700029782H1 | SATMON003 | g2191140 | BLASTN | 205 | 1e-30 | 60 |
| 1099 | 23328 | 701182619H1 | SATMONN06 | g2505876 | BLASTN | 184 | 1e-28 | 55 |
| 1100 | 23328 | 701182651H1 | SATMONN06 | g2505876 | BLASTN | 195 | 1e-30 | 56 |
| 1101 | 23697 | 701171068H1 | SATMONN05 | g2245137 | BLASTN | 117 | 1e-24 | 76 |
| 1102 | 23923 | 700575127H1 | SATMON030 | g556409 | BLASTN | 170 | 1e-25 | 58 |
| 1103 | 24011 | LIB3067-060-Q1-K1-A5 | LIB3067 | g1244714 | BLASTN | 131 | 1e-35 | 41 |
| 1104 | 24165 | 700551855H1 | SATMON022 | g508577 | BLASTN | 138 | 1e-23 | 65 |
| 1105 | 24165 | LIB3068-025-Q1-K1-C7 | LIB3068 | g508577 | BLASTN | 128 | 1e-38 | 58 |
| 1106 | 24165 | LIB3069-039-Q1-K1-G10 | LIB3069 | g1206002 | BLASTN | 555 | 1e-35 | 67 |
| 1107 | 2432 | 700150729H1 | SATMON007 | g1420923 | BLASTN | 250 | 1e-09 | 81 |
| 1108 | 2432 | 700344645H1 | SATMON021 | g1420923 | BLASTN | 250 | 1e-09 | 81 |
| 1109 | 2432 | 700551468H1 | SATMON022 | g1420923 | BLASTN | 250 | 1e-09 | 81 |
| 1110 | 24344 | 700352172H1 | SATMON023 | g951171 | BLASTN | 774 | 1e-95 | 96 |
| 1111 | 24344 | LIB3059-042-Q1-K1-E7 | LIB3059 | g1167913 | BLASTN | 1972 | 1e-157 | 98 |
| 1112 | 24344 | LIB3067-059-Q1-K1-C4 | LIB3067 | g951171 | BLASTN | 1470 | 1e-171 | 96 |
| 1113 | 24344 | LIB3067-058-Q1-K1-F6 | LIB3067 | g951171 | BLASTN | 1841 | 1e-157 | 97 |
| 1114 | 24766 | LIB3067-032-Q1-K1-B1 | LIB3067 | g508576 | BLASTN | 847 | 1e-61 | 75 |
| 1115 | 24766 | LIB3067-059-Q1-K1-A11 | LIB3067 | g508576 | BLASTN | 720 | 1e-51 | 80 |
| 1116 | 24766 | LIB3069-031-Q1-K1-H4 | LIB3069 | g508576 | BLASTN | 633 | 1e-42 | 81 |
| 1117 | 25149 | 700045930H1 | SATMON004 | g2826884 | BLASTN | 148 | 1e-24 | 50 |
| 1118 | 25149 | 700470039H1 | SATMON025 | g2826884 | BLASTN | 167 | 1e-25 | 56 |
| 1119 | 25149 | LIB3059-035-Q1-K1-H9 | LIB3059 | g2826884 | BLASTN | 180 | 1e-52 | 57 |
| 1120 | 25399 | 700258915H1 | SATMON017 | g1945282 | BLASTN | 512 | 1e-33 | 84 |
| 1121 | 25399 | 701165922H1 | SATMONN04 | g1945282 | BLASTN | 569 | 1e-41 | 87 |
| 1122 | 25421 | 700018462H1 | SATMON001 | g945086 | BLASTN | 469 | 1e-30 | 74 |
| 1123 | 25421 | 700573169H1 | SATMON030 | g945086 | BLASTN | 894 | 1e-65 | 74 |
| 1124 | 25421 | 701164692H1 | SATMONN04 | g945087 | BLASTN | 132 | 1e-20 | 52 |
| 1125 | 25421 | LIB189-007-Q1-E1-E6 | LIB189 | g945086 | BLASTN | 940 | 1e-69 | 72 |
| 1126 | 26277 | LIB3061-020-Q1-K1-G7 | LIB3061 | g1945282 | BLASTN | 1139 | 1e-86 | 77 |
| 1127 | 26352 | LIB143-011-Q1-E1-B7 | LIB143 | g1945280 | BLASTN | 731 | 1e-60 | 79 |
| 1128 | 26352 | LIB3061-045-Q1-K1-A8 | LIB3061 | g1945280 | BLASTN | 930 | 1e-68 | 74 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1129 | 26465 | 700100432H1 | SATMON009 | g2702280 | BLASTN | 172 | 1e-25 | 89 |
| 1130 | 26503 | 700443369H1 | SATMON027 | g2505876 | BLASTN | 80 | 1e-18 | 71 |
| 1131 | 26503 | LIB3060-017-Q1-K1-C5 | LIB3060 | g2505876 | BLASTN | 213 | 1e-49 | 74 |
| 1132 | 26864 | 700204678H1 | SATMON003 | g2826884 | BLASTN | 176 | 1e-27 | 77 |
| 1133 | 26864 | LIB3059-044-Q1-K1-F4 | LIB3059 | g1429226 | BLASTN | 203 | 1e-47 | 73 |
| 1134 | 27009 | LIB83-013-Q1-E1-H1 | LIB83 | g2980802 | BLASTN | 152 | 1e-53 | 63 |
| 1135 | 27111 | LIB3062-045-Q1-K1-B11 | LIB3062 | g945087 | BLASTN | 221 | 1e-48 | 87 |
| 1136 | 2728 | 700212033H1 | SATMON016 | g2245389 | BLASTN | 171 | 1e-09 | 80 |
| 1137 | 27567 | LIB3067-002-Q1-K1-B10 | LIB3067 | g1905943 | BLASTN | 591 | 1e-39 | 92 |
| 1138 | 27567 | LIB3067-049-Q1-K1-D7 | LIB3067 | g1905943 | BLASTN | 294 | 1e-29 | 79 |
| 1139 | 27660 | LIB3069-033-Q1-K1-F11 | LIB3069 | g3183617 | BLASTN | 243 | 1e-51 | 84 |
| 1140 | 27677 | 700332676H1 | SATMON019 | g2463332 | BLASTN | 560 | 1e-37 | 90 |
| 1141 | 27677 | LIB3069-009-Q1-K1-H3 | LIB3069 | g2463332 | BLASTN | 744 | 1e-51 | 77 |
| 1142 | 27677 | LIB3069-020-Q1-K1-H6 | LIB3069 | g1914837 | BLASTN | 708 | 1e-48 | 77 |
| 1143 | 27687 | 700053756H1 | SATMON011 | g2104678 | BLASTN | 316 | 1e-26 | 70 |
| 1144 | 27687 | LIB3078-050-Q1-K1-B6 | LIB3078 | g2104678 | BLASTN | 377 | 1e-42 | 65 |
| 1145 | 27707 | 700157026H1 | SATMON012 | g2062176 | BLASTN | 174 | 1e-25 | 60 |
| 1146 | 27707 | LIB3078-054-Q1-K1-A12 | LIB3078 | g786425 | BLASTN | 384 | 1e-20 | 65 |
| 1147 | 27904 | LIB148-063-Q1-E1-C7 | LIB148 | g1890351 | BLASTN | 511 | 1e-31 | 69 |
| 1148 | 27946 | LIB143-017-Q1-E1-A1 | LIB143 | g2920839 | BLASTN | 424 | 1e-78 | 79 |
| 1149 | 28304 | LIB3062-021-Q1-K1-F6 | LIB3062 | g939784 | BLASTN | 523 | 1e-36 | 83 |
| 1150 | 28304 | LIB3067-031-Q1-K1-H5 | LIB3067 | g939784 | BLASTN | 321 | 1e-19 | 85 |
| 1151 | 28304 | LIB3069-029-Q1-K1-H10 | LIB3069 | g939784 | BLASTN | 540 | 1e-36 | 84 |
| 1152 | 28366 | LIB3062-015-Q1-K1-B9 | LIB3062 | g2642435 | BLASTN | 106 | 1e-38 | 66 |
| 1153 | 28408 | 700343287H1 | SATMON021 | g1905943 | BLASTN | 879 | 1e-64 | 95 |
| 1154 | 28408 | LIB3067-049-Q1-K1-C2 | LIB3067 | g1905943 | BLASTN | 895 | 1e-65 | 94 |
| 1155 | 28408 | LIB3068-037-Q1-K1-C1 | LIB3068 | g1905943 | BLASTN | 1025 | 1e-91 | 95 |
| 1156 | 28408 | LIB3068-057-Q1-K1-F6 | LIB3068 | g1905943 | BLASTN | 977 | 1e-98 | 93 |
| 1157 | 28408 | LIB3068-061-Q1-K1-D4 | LIB3068 | g1905943 | BLASTN | 1018 | 1e-93 | 92 |
| 1158 | 28420 | 700048913H1 | SATMON003 | g22379 | BLASTN | 540 | 1e-55 | 100 |
| 1159 | 28420 | 700208012H1 | SATMON016 | g22379 | BLASTN | 156 | 1e-16 | 99 |
| 1160 | 28420 | LIB3061-023-Q1-K1-H1 | LIB3061 | g22379 | BLASTN | 604 | 1e-76 | 98 |
| 1161 | 28786 | 700342374H1 | SATMON021 | g1905943 | BLASTN | 942 | 1e-72 | 95 |
| 1162 | 28786 | LIB3067-005-Q1-K1-A5 | LIB3067 | g1905943 | BLASTN | 1162 | 1e-115 | 95 |
| 1163 | 28786 | LIB3067-029-Q1-K1-C1 | LIB3067 | g2286112 | BLASTN | 1578 | 1e-122 | 85 |
| 1164 | 28786 | LIB3067-029-Q1-K1-D1 | LIB3067 | g2286112 | BLASTN | 1535 | 1e-119 | 85 |
| 1165 | 28786 | LIB3068-043-Q1-K1-C7 | LIB3068 | g1905943 | BLASTN | 1082 | 1e-86 | 94 |
| 1166 | 28786 | LIB3068-041-Q1-K1-B6 | LIB3068 | g1905943 | BLASTN | 1168 | 1e-99 | 90 |
| 1167 | 28804 | 700160819H1 | SATMON012 | g786426 | BLASTN | 143 | 1e-29 | 63 |
| 1168 | 28804 | 700169331H1 | SATMON013 | g786426 | BLASTN | 143 | 1e-26 | 78 |
| 1169 | 28804 | 700238677H1 | SATMON010 | g786426 | BLASTN | 132 | 1e-28 | 67 |
| 1170 | 28804 | LIB3079-002-Q1-K1-E9 | LIB3079 | g786426 | BLASTN | 133 | 1e-44 | 67 |
| 1171 | 28804 | LIB83-013-Q1-E1-E7 | LIB83 | g786426 | BLASTN | 143 | 1e-51 | 65 |
| 1172 | 289 | 700025965H1 | SATMON003 | g1666172 | BLASTN | 733 | 1e-52 | 74 |
| 1173 | 289 | 700074026H1 | SATMON007 | g1666172 | BLASTN | 730 | 1e-52 | 74 |

-continued

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1174 | 289 | 700088568H1 | SATMON011 | g1666172 | BLASTN | 680 | 1e-48 | 74 |
| 1175 | 289 | 700102589H1 | SATMON010 | g1666172 | BLASTN | 670 | 1e-47 | 74 |
| 1176 | 289 | 700162412H1 | SATMON012 | g1666172 | BLASTN | 536 | 1e-36 | 71 |
| 1177 | 289 | 700163161H1 | SATMON013 | g1666173 | BLASTN | 116 | 1e-18 | 50 |
| 1178 | 289 | 700624536H1 | SATMON034 | g1666172 | BLASTN | 685 | 1e-48 | 72 |
| 1179 | 289 | LIB143-009-Q1-E1-B4 | LIB143 | g1666172 | BLASTN | 663 | 1e-44 | 69 |
| 1180 | 289 | LIB3059-020-Q1-K1-B12 | LIB3059 | g1666172 | BLASTN | 777 | 1e-56 | 74 |
| 1181 | 289 | LIB3079-007-Q1-K1-B7 | LIB3079 | g1666172 | BLASTN | 795 | 1e-57 | 74 |
| 1182 | 289 | LIB84-030-Q1-E1-A2 | LIB84 | g1666172 | BLASTN | 557 | 1e-54 | 72 |
| 1183 | 29009 | LIB3059-049-Q1-K1-B3 | LIB3059 | g22380 | BLASTN | 142 | 1e-36 | 60 |
| 1184 | 29460 | 700475741H1 | SATMON025 | g2443887 | BLASTN | 153 | 1e-30 | 80 |
| 1185 | 2963 | 700241724H1 | SATMON010 | g1572786 | BLASTN | 84 | 1e-21 | 42 |
| 1186 | 2963 | 700242763H1 | SATMON010 | g1572786 | BLASTN | 86 | 1e-23 | 42 |
| 1187 | 29791 | 700171754H1 | SATMON013 | g1232131 | BLASTN | 517 | 1e-41 | 82 |
| 1188 | 30095 | 700104947H1 | SATMON010 | g1420923 | BLASTN | 242 | 1e-09 | 91 |
| 1189 | 30254 | 701178677H1 | SATMONN05 | g1707639 | BLASTN | 494 | 1e-62 | 83 |
| 1190 | 30254 | LIB3079-021-Q1-K1-D7 | LIB3079 | g1707639 | BLASTN | 672 | 1e-94 | 80 |
| 1191 | 31077 | LIB3067-005-Q1-K1-F7 | LIB3067 | g939784 | BLASTN | 221 | 1e-21 | 98 |
| 1192 | 31077 | LIB3067-049-Q1-K1-C4 | LIB3067 | g939784 | BLASTN | 265 | 1e-24 | 95 |
| 1193 | 31174 | 700282073H1 | SATMON022 | g1199574 | BLASTN | 398 | 1e-22 | 61 |
| 1194 | 31174 | LIB3067-046-Q1-K1-E10 | LIB3067 | g1049022 | BLASTN | 150 | 1e-58 | 49 |
| 1195 | 31174 | LIB3069-051-Q1-K1-B3 | LIB3069 | g2979566 | BLASTN | 234 | 1e-57 | 48 |
| 1196 | 31175 | 700553186H1 | SATMON022 | g886400 | BLASTN | 669 | 1e-68 | 88 |
| 1197 | 31175 | LIB3067-010-Q1-K1-G12 | LIB3067 | g886400 | BLASTN | 905 | 1e-104 | 82 |
| 1198 | 313 | 700030176H1 | SATMON003 | g2982330 | BLASTN | 727 | 1e-56 | 79 |
| 1199 | 313 | 700089309H1 | SATMON011 | g290056 | BLASTN | 683 | 1e-48 | 73 |
| 1200 | 313 | 700160174H1 | SATMON012 | g290056 | BLASTN | 672 | 1e-47 | 75 |
| 1201 | 313 | 700160389H1 | SATMON012 | g290056 | BLASTN | 695 | 1e-49 | 78 |
| 1202 | 313 | 700193966H1 | SATMON014 | g2982330 | BLASTN | 459 | 1e-32 | 87 |
| 1203 | 313 | 700198034H1 | SATMON016 | g290056 | BLASTN | 690 | 1e-48 | 78 |
| 1204 | 313 | 700223702H1 | SATMON011 | g1353667 | BLASTN | 195 | 1e-28 | 76 |
| 1205 | 313 | 700256992H1 | SATMON017 | g2982331 | BLASTN | 114 | 1e-31 | 95 |
| 1206 | 313 | 700334428H1 | SATMON019 | g290057 | BLASTN | 215 | 1e-44 | 69 |
| 1207 | 313 | 700345766H1 | SATMON021 | g2982330 | BLASTN | 573 | 1e-39 | 79 |
| 1208 | 313 | 700428724H1 | SATMONN01 | g2982330 | BLASTN | 840 | 1e-61 | 79 |
| 1209 | 313 | 700438829H1 | SATMON026 | g290056 | BLASTN | 331 | 1e-33 | 75 |
| 1210 | 313 | 700438866H1 | SATMON026 | g290056 | BLASTN | 681 | 1e-47 | 73 |
| 1211 | 313 | 700455822H1 | SATMON029 | g2982330 | BLASTN | 782 | 1e-56 | 79 |
| 1212 | 313 | 700456156H1 | SATMON029 | g2982330 | BLASTN | 804 | 1e-58 | 79 |
| 1213 | 313 | 700457422H1 | SATMON029 | g2982330 | BLASTN | 793 | 1e-57 | 78 |
| 1214 | 313 | 700464587H1 | SATMON025 | g290056 | BLASTN | 572 | 1e-38 | 76 |
| 1215 | 313 | 700472413H1 | SATMON025 | g2982330 | BLASTN | 893 | 1e-65 | 78 |
| 1216 | 313 | 700549413H1 | SATMON022 | g2982330 | BLASTN | 825 | 1e-60 | 79 |
| 1217 | 313 | 700549675H1 | SATMON022 | g290056 | BLASTN | 426 | 1e-51 | 76 |
| 1218 | 313 | 700550305H1 | SATMON022 | g2982330 | BLASTN | 863 | 1e-63 | 79 |
| 1219 | 313 | 700576902H1 | SATMON031 | g290057 | BLASTN | 139 | 1e-28 | 83 |
| 1220 | 313 | 700582445H1 | SATMON031 | g2982330 | BLASTN | 465 | 1e-29 | 80 |
| 1221 | 313 | 700614836H1 | SATMON033 | g290056 | BLASTN | 399 | 1e-24 | 78 |
| 1222 | 313 | LIB148-052-Q1-E1-A5 | LIB148 | g290056 | BLASTN | 795 | 1e-58 | 74 |
| 1223 | 313 | LIB189-019-Q1-E1-G7 | LIB189 | g290056 | BLASTN | 645 | 1e-89 | 74 |
| 1224 | 313 | LIB3059-003-Q1-K1-C10 | LIB3059 | g290056 | BLASTN | 1165 | 1e-88 | 74 |
| 1225 | 313 | LIB3059-040-Q1-K1-F9 | LIB3059 | g290056 | BLASTN | 1252 | 1e-95 | 75 |
| 1226 | 313 | LIB3061-034-Q1-K1-B7 | LIB3061 | g290056 | BLASTN | 924 | 1e-68 | 75 |
| 1227 | 313 | LIB3062-039-Q1-K1-F1 | LIB3062 | g2982330 | BLASTN | 1207 | 1e-105 | 79 |
| 1228 | 313 | LIB3069-006-Q1-K1-F8 | LIB3069 | g290056 | BLASTN | 756 | 1e-54 | 74 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1229 | 313 | LIB3079-014-Q1-K1-H12 | LIB3079 | g290056 | BLASTN | 967 | 1e-71 | 71 |
| 1230 | 313 | LIB83-008-Q1-E1-E4 | LIB83 | g290056 | BLASTN | 834 | 1e-78 | 73 |
| 1231 | 3191 | 700098953H1 | SATMON009 | g2735839 | BLASTN | 283 | 1e-12 | 69 |
| 1232 | 31934 | 700350370H1 | SATMON023 | g508577 | BLASTN | 81 | 1e-20 | 49 |
| 1233 | 31934 | LIB3069-033-Q1-K1-G4 | LIB3069 | g508576 | BLASTN | 658 | 1e-49 | 73 |
| 1234 | 31938 | LIB3068-005-Q1-K1-D12 | LIB3068 | g218339 | BLASTN | 304 | 1e-26 | 76 |
| 1235 | 31938 | LIB3068-044-Q1-K1-G10 | LIB3068 | g218339 | BLASTN | 571 | 1e-75 | 73 |
| 1236 | 31977 | LIB3062-018-Q1-K1-B10 | LIB3062 | g2464855 | BLASTN | 250 | 1e-70 | 74 |
| 1237 | 31977 | LIB3069-031-Q1-K1-G7 | LIB3069 | g1263095 | BLASTN | 117 | 1e-43 | 73 |
| 1238 | 32236 | LIB3060-007-Q1-K1-F7 | LIB3060 | g2653353 | BLASTN | 56 | 1e-33 | 37 |
| 1239 | 32402 | LIB3059-037-Q1-K1-A3 | LIB3059 | g1905929 | BLASTN | 899 | 1e-98 | 82 |
| 1240 | 32402 | LIB3067-032-Q1-K1-C5 | LIB3067 | g2463332 | BLASTN | 1035 | 1e-77 | 84 |
| 1241 | 32442 | LIB3060-041-Q1-K1-C5 | LIB3060 | g2911067 | BLASTN | 503 | 1e-87 | 69 |
| 1242 | 32675 | LIB143-003-Q1-E1-E5 | LIB143 | g2062176 | BLASTN | 228 | 1e-49 | 62 |
| 1243 | 32760 | 700343406H1 | SATMON021 | g1905943 | BLASTN | 454 | 1e-63 | 95 |
| 1244 | 32760 | LIB189-029-Q1-E1-D2 | LIB189 | g1905943 | BLASTN | 912 | 1e-80 | 91 |
| 1245 | 3309 | 700092223H1 | SATMON008 | g2826884 | BLASTN | 92 | 1e-21 | 58 |
| 1246 | 3309 | 700334938H1 | SATMON019 | g2149996 | BLASTN | 120 | 1e-18 | 43 |
| 1247 | 339 | 700624240H1 | SATMON034 | g551535 | BLASTN | 89 | 1e-22 | 47 |
| 1248 | 339 | 701185145H1 | SATMONN06 | g1616942 | BLASTN | 90 | 1e-19 | 56 |
| 1249 | 3641 | 700102125H1 | SATMON010 | g2088643 | BLASTN | 278 | 1e-42 | 68 |
| 1250 | 3641 | 700105011H1 | SATMON010 | g2088643 | BLASTN | 255 | 1e-39 | 67 |
| 1251 | 385 | 700624403H1 | SATMON034 | g624936 | BLASTN | 297 | 1e-46 | 75 |
| 1252 | 4116 | 700105887H1 | SATMON010 | g1850792 | BLASTN | 303 | 1e-37 | 77 |
| 1253 | 4224 | LIB3062-025-Q1-K1-D8 | LIB3062 | g20810 | BLASTN | 61 | 1e-35 | 36 |
| 1254 | 4334 | 700019455H1 | SATMON001 | g18819 | BLASTN | 137 | 1e-21 | 65 |
| 1255 | 4334 | 700051166H1 | SATMON003 | g1850792 | BLASTN | 539 | 1e-45 | 78 |
| 1256 | 4334 | 700165809H1 | SATMON013 | g1850792 | BLASTN | 293 | 1e-13 | 84 |
| 1257 | 4334 | 700206973H1 | SATMON003 | g1850792 | BLASTN | 539 | 1e-44 | 79 |
| 1258 | 4334 | 700210639H1 | SATMON016 | g1850792 | BLASTN | 534 | 1e-34 | 79 |
| 1259 | 4334 | 700618659H1 | SATMON033 | g1850792 | BLASTN | 525 | 1e-34 | 79 |
| 1260 | 4334 | 701182729H1 | SATMONN06 | g1850792 | BLASTN | 536 | 1e-35 | 80 |
| 1261 | 4334 | LIB3061-021-Q1-K1-D2 | LIB3061 | g1850792 | BLASTN | 527 | 1e-32 | 80 |
| 1262 | 4573 | 700042919H1 | SATMON004 | g556559 | BLASTN | 823 | 1e-71 | 85 |
| 1263 | 4573 | 700049033H1 | SATMON003 | g556559 | BLASTN | 623 | 1e-69 | 83 |
| 1264 | 4573 | 700084460H1 | SATMON011 | g556559 | BLASTN | 669 | 1e-46 | 85 |
| 1265 | 4573 | 700087791H1 | SATMON011 | g556559 | BLASTN | 538 | 1e-58 | 79 |
| 1266 | 4573 | 700091679H1 | SATMON011 | g556559 | BLASTN | 714 | 1e-50 | 84 |
| 1267 | 4573 | 700105061H1 | SATMON010 | g556559 | BLASTN | 957 | 1e-84 | 84 |
| 1268 | 4573 | 700151850H1 | SATMON007 | g556559 | BLASTN | 458 | 1e-29 | 80 |
| 1269 | 4573 | 700152094H1 | SATMON007 | g556559 | BLASTN | 676 | 1e-47 | 82 |
| 1270 | 4573 | 700153866H1 | SATMON007 | g556559 | BLASTN | 513 | 1e-33 | 81 |
| 1271 | 4573 | 700157329H1 | SATMON012 | g556559 | BLASTN | 680 | 1e-47 | 88 |
| 1272 | 4573 | 700166186H1 | SATMON013 | g556559 | BLASTN | 843 | 1e-61 | 81 |
| 1273 | 4573 | 700211938H1 | SATMON016 | g556559 | BLASTN | 979 | 1e-72 | 83 |
| 1274 | 4573 | 700220444H1 | SATMON011 | g556559 | BLASTN | 979 | 1e-72 | 85 |
| 1275 | 4573 | 700220672H1 | SATMON011 | g556559 | BLASTN | 1060 | 1e-79 | 86 |
| 1276 | 4573 | 700235948H1 | SATMON010 | g556559 | BLASTN | 545 | 1e-36 | 81 |
| 1277 | 4573 | 700342736H1 | SATMON021 | g556559 | BLASTN | 744 | 1e-53 | 81 |
| 1278 | 4573 | 700345985H1 | SATMON021 | g556559 | BLASTN | 614 | 1e-42 | 79 |
| 1279 | 4573 | 700346688H1 | SATMON021 | g556559 | BLASTN | 1091 | 1e-82 | 90 |
| 1280 | 4573 | 700349034H1 | SATMON023 | g556559 | BLASTN | 693 | 1e-48 | 81 |
| 1281 | 4573 | 700349063H1 | SATMON023 | g556559 | BLASTN | 702 | 1e-49 | 84 |
| 1282 | 4573 | 700350681H1 | SATMON023 | g556559 | BLASTN | 579 | 1e-39 | 83 |
| 1283 | 4573 | 700441320H1 | SATMON026 | g556559 | BLASTN | 362 | 1e-20 | 70 |
| 1284 | 4573 | 700471104H1 | SATMON025 | g556559 | BLASTN | 693 | 1e-48 | 81 |
| 1285 | 4573 | 700550827H1 | SATMON022 | g556559 | BLASTN | 693 | 1e-48 | 81 |
| 1286 | 4573 | 700553306H1 | SATMON022 | g556559 | BLASTN | 674 | 1e-47 | 81 |
| 1287 | 4573 | 700581493H1 | SATMON031 | g556559 | BLASTN | 584 | 1e-67 | 82 |

-continued

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1288 | 4573 | 700611766H1 | SATMON022 | g556559 | BLASTN | 342 | 1e−22 | 77 |
| 1289 | 4573 | LIB3059-027-Q1-K1-C2 | LIB3059 | g556559 | BLASTN | 893 | 1e−65 | 81 |
| 1290 | 4573 | LIB3061-046-Q1-K1-F6 | LIB3061 | g556559 | BLASTN | 1327 | 1e−101 | 80 |
| 1291 | 4573 | LIB3062-018-Q1-K1-D6 | LIB3062 | g556559 | BLASTN | 317 | 1e−35 | 79 |
| 1292 | 4573 | LIB3062-029-Q1-K1-C8 | LIB3062 | g556559 | BLASTN | 1307 | 1e−100 | 83 |
| 1293 | 4573 | LIB3062-038-Q1-K1-H8 | LIB3062 | g556559 | BLASTN | 1664 | 1e−129 | 82 |
| 1294 | 4573 | LIB3068-003-Q1-K1-H6 | LIB3068 | g556559 | BLASTN | 1451 | 1e−112 | 88 |
| 1295 | 4573 | LIB3068-033-Q1-K1-H5 | LIB3068 | g556559 | BLASTN | 1705 | 1e−133 | 85 |
| 1296 | 4573 | LIB3068-033-Q1-K1-H9 | LIB3068 | g556559 | BLASTN | 1610 | 1e−141 | 88 |
| 1297 | 4573 | LIB3068-033-Q1-K1-H10 | LIB3068 | g556559 | BLASTN | 1168 | 1e−88 | 83 |
| 1298 | 4573 | LIB3078-018-Q1-K1-H2 | LIB3078 | g556559 | BLASTN | 1569 | 1e−122 | 83 |
| 1299 | 4675 | 700343053H1 | SATMON021 | g2735839 | BLASTN | 917 | 1e−99 | 94 |
| 1300 | 4675 | 700347336H1 | SATMON021 | g2735839 | BLASTN | 750 | 1e−73 | 90 |
| 1301 | 4675 | 700451244H1 | SATMON028 | g2735839 | BLASTN | 426 | 1e−55 | 92 |
| 1302 | 4726 | 700042529H1 | SATMON004 | g1429227 | BLASTN | 388 | 1e−43 | 77 |
| 1303 | 4726 | 700094180H1 | SATMON008 | g1429228 | BLASTN | 112 | 1e−18 | 85 |
| 1304 | 4726 | 700153844H1 | SATMON007 | g2826882 | BLASTN | 200 | 1e−31 | 95 |
| 1305 | 4726 | 700154748H1 | SATMON007 | g2826881 | BLASTN | 494 | 1e−32 | 78 |
| 1306 | 4726 | 700167910H1 | SATMON013 | g2826882 | BLASTN | 162 | 1e−26 | 94 |
| 1307 | 4726 | 700238147H1 | SATMON010 | g2826882 | BLASTN | 187 | 1e−29 | 75 |
| 1308 | 4726 | 700243593H1 | SATMON010 | g2826881 | BLASTN | 509 | 1e−33 | 79 |
| 1309 | 4726 | 700266003H1 | SATMON017 | g2826881 | BLASTN | 604 | 1e−41 | 82 |
| ERROR | 4726 | | SATMONN01 | CLUSTER | | | | |
| 1310 | 4726 | 700618813H1 | SATMON034 | g2826881 | BLASTN | 569 | 1e−38 | 78 |
| 1311 | 4726 | LIB143-031-Q1-E1-B4 | LIB143 | g2826881 | BLASTN | 601 | 1e−39 | 71 |
| 1312 | 4726 | LIB3067-037-Q1-K1-G10 | LIB3067 | g2826881 | BLASTN | 592 | 1e−38 | 76 |
| 1313 | 4726 | LIB3067-057-Q1-K1-A8 | LIB3067 | g2826881 | BLASTN | 724 | 1e−50 | 78 |
| 1314 | 4726 | LIB3078-033-Q1-K1-C11 | LIB3078 | g2826881 | BLASTN | 848 | 1e−62 | 77 |
| 1315 | 4825 | 700342288H1 | SATMON021 | g2463332 | BLASTN | 316 | 1e−31 | 78 |
| 1316 | 4825 | 700347334H1 | SATMON021 | g2463332 | BLASTN | 439 | 1e−47 | 74 |
| 1317 | 4825 | LIB3067-030-Q1-K1-E9 | LIB3067 | g2286110 | BLASTN | 333 | 1e−38 | 78 |
| 1318 | 4837 | 700091432H1 | SATMON011 | g2160167 | BLASTN | 241 | 1e−34 | 42 |
| 1319 | 4837 | 700342234H1 | SATMON021 | g1747310 | BLASTN | 194 | 1e−28 | 44 |
| 1320 | 4837 | LIB143-058-Q1-E1-G4 | LIB143 | g2160167 | BLASTN | 207 | 1e−46 | 39 |
| 1321 | 5120 | 700091876H1 | SATMON011 | g2982330 | BLASTN | 668 | 1e−47 | 78 |
| 1322 | 5120 | 700445847H1 | SATMON027 | g2982330 | BLASTN | 466 | 1e−44 | 79 |
| 1323 | 5120 | 700445848H1 | SATMON027 | g2982330 | BLASTN | 470 | 1e−44 | 77 |
| 1324 | 5120 | 700614010H1 | SATMON033 | g2982330 | BLASTN | 489 | 1e−30 | 77 |
| 1325 | 5182 | 700093349H1 | SATMON008 | g2104681 | BLASTN | 166 | 1e−26 | 73 |
| 1326 | 5182 | 700167439H1 | SATMON013 | g2104681 | BLASTN | 160 | 1e−23 | 78 |
| 1327 | 5182 | 700265385H1 | SATMON017 | g2104681 | BLASTN | 166 | 1e−24 | 76 |
| 1328 | 5468 | 700082261H1 | SATMON011 | g2735764 | BLASTN | 116 | 1e−17 | 32 |
| 1329 | 5468 | 700172754H1 | SATMON013 | g2735764 | BLASTN | 148 | 1e−22 | 48 |
| 1330 | 6098 | 700023212H1 | SATMON003 | g556557 | BLASTN | 1032 | 1e−77 | 87 |
| 1331 | 6098 | 700026534H1 | SATMON003 | g556557 | BLASTN | 1035 | 1e−77 | 84 |
| 1332 | 6098 | 700050928H1 | SATMON003 | g556557 | BLASTN | 818 | 1e−59 | 87 |
| 1333 | 6098 | 700082788H1 | SATMON011 | g556557 | BLASTN | 1250 | 1e−95 | 88 |
| 1334 | 6098 | 700151293H1 | SATMON007 | g556557 | BLASTN | 672 | 1e−47 | 89 |
| 1335 | 6098 | 700156895H1 | SATMON012 | g556557 | BLASTN | 997 | 1e−74 | 89 |
| 1336 | 6098 | 700160036H1 | SATMON012 | g556557 | BLASTN | 978 | 1e−72 | 87 |
| 1337 | 6098 | 700169134H1 | SATMON013 | g556557 | BLASTN | 895 | 1e−65 | 87 |
| 1338 | 6098 | 700196770H1 | SATMON014 | g556558 | BLASTN | 135 | 1e−20 | 100 |
| 1339 | 6098 | 700204094H1 | SATMON003 | g556557 | BLASTN | 418 | 1e−26 | 79 |
| 1340 | 6098 | 700207890H1 | SATMON016 | g556557 | BLASTN | 1196 | 1e−90 | 88 |
| 1341 | 6098 | 700209368H1 | SATMON016 | g556557 | BLASTN | 1080 | 1e−89 | 86 |
| 1342 | 6098 | 700216846H1 | SATMON016 | g556557 | BLASTN | 984 | 1e−73 | 84 |
| 1343 | 6098 | 700217125H1 | SATMON016 | g556557 | BLASTN | 911 | 1e−67 | 84 |
| 1344 | 6098 | 700335980H1 | SATMON019 | g556557 | BLASTN | 554 | 1e−37 | 86 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1345 | 6098 | 700350881H1 | SATMON023 | g556557 | BLASTN | 699 | 1e−73 | 82 |
| 1346 | 6098 | 700379915H1 | SATMON021 | g556557 | BLASTN | 1117 | 1e−84 | 86 |
| 1347 | 6098 | 700405447H1 | SATMON029 | g556557 | BLASTN | 515 | 1e−34 | 91 |
| 1348 | 6098 | 700423625H1 | SATMONN01 | g556557 | BLASTN | 942 | 1e−69 | 84 |
| 1349 | 6098 | 700445715H1 | SATMON027 | g556557 | BLASTN | 1107 | 1e−83 | 87 |
| 1350 | 6098 | 700576616H1 | SATMON030 | g556557 | BLASTN | 710 | 1e−50 | 84 |
| 1351 | 6098 | 700581258H1 | SATMON031 | g556557 | BLASTN | 757 | 1e−69 | 83 |
| 1352 | 6098 | 700621691H1 | SATMON034 | g556557 | BLASTN | 955 | 1e−97 | 87 |
| 1353 | 6098 | 700622003H1 | SATMON034 | g556557 | BLASTN | 302 | 1e−14 | 90 |
| 1354 | 6098 | 701183623H1 | SATMONN06 | g556557 | BLASTN | 956 | 1e−70 | 84 |
| 1355 | 6098 | 701183722H1 | SATMONN06 | g556557 | BLASTN | 568 | 1e−38 | 70 |
| 1356 | 6098 | LIB3059-047-Q1-K1-C2 | LIB3059 | g556557 | BLASTN | 998 | 1e−114 | 87 |
| 1357 | 6098 | LIB3069-022-Q1-K1-B3 | LIB3069 | g556557 | BLASTN | 1458 | 1e−112 | 83 |
| 1358 | 6098 | LIB3078-029-Q1-K1-B7 | LIB3078 | g556557 | BLASTN | 990 | 1e−73 | 84 |
| 1359 | 6196 | 700102457H1 | SATMON010 | g556559 | BLASTN | 1239 | 1e−94 | 86 |
| 1360 | 6196 | 700154733H1 | SATMON007 | g556559 | BLASTN | 779 | 1e−59 | 86 |
| 1361 | 6196 | 700161033H1 | SATMON012 | g556559 | BLASTN | 866 | 1e−63 | 86 |
| 1362 | 6196 | 700163235H1 | SATMON013 | g556559 | BLASTN | 912 | 1e−67 | 85 |
| 1363 | 6196 | 700552020H1 | SATMON022 | g556559 | BLASTN | 1065 | 1e−79 | 85 |
| 1364 | 6196 | LIB3062-021-Q1-K1-G12 | LIB3062 | g556559 | BLASTN | 1113 | 1e−83 | 85 |
| 1365 | 6196 | LIB3069-042-Q1-K1-C9 | LIB3069 | g556559 | BLASTN | 1264 | 1e−106 | 85 |
| 1366 | 6422 | 700048971H1 | SATMON003 | g2735766 | BLASTN | 198 | 1e−31 | 75 |
| 1367 | 6422 | 700049939H1 | SATMON003 | g2286110 | BLASTN | 444 | 1e−26 | 74 |
| 1368 | 6422 | 700163770H1 | SATMON013 | g2735766 | BLASTN | 116 | 1e−18 | 79 |
| 1369 | 6422 | 700166354H1 | SATMON013 | g431908 | BLASTN | 203 | 1e−30 | 64 |
| 1370 | 6422 | 700169344H1 | SATMON013 | g508576 | BLASTN | 191 | 1e−11 | 79 |
| 1371 | 6422 | 700471581H1 | SATMON025 | g2735764 | BLASTN | 142 | 1e−27 | 75 |
| 1372 | 6508 | 700030014H1 | SATMON003 | g2160167 | BLASTN | 255 | 1e−36 | 48 |
| 1373 | 6508 | 700087039H1 | SATMON011 | g2160167 | BLASTN | 268 | 1e−38 | 50 |
| 1374 | 6508 | 701180711H1 | SATMONN06 | g1747310 | BLASTN | 194 | 1e−32 | 62 |
| 1375 | 7120 | 700805333H1 | SATMON036 | g309569 | BLASTN | 181 | 1e−10 | 95 |
| 1376 | 7914 | 700553220H1 | SATMON022 | g1239960 | BLASTN | 263 | 1e−11 | 64 |
| 1377 | 7914 | 700553228H1 | SATMON022 | g1239960 | BLASTN | 446 | 1e−26 | 69 |
| 1378 | 7914 | LIB3067-006-Q1-K1-B4 | LIB3067 | g939784 | BLASTN | 537 | 1e−33 | 62 |
| 1379 | 7914 | LIB3067-018-Q1-K1-F7 | LIB3067 | g939784 | BLASTN | 518 | 1e−32 | 62 |
| 1380 | 7971 | 700053716H1 | SATMON011 | g556559 | BLASTN | 742 | 1e−53 | 84 |
| 1381 | 7971 | 700073727H1 | SATMON007 | g556559 | BLASTN | 1027 | 1e−76 | 86 |
| 1382 | 7971 | 700086649H1 | SATMON011 | g556559 | BLASTN | 331 | 1e−17 | 74 |
| 1383 | 7971 | 700208117H1 | SATMON016 | g556559 | BLASTN | 468 | 1e−28 | 82 |
| 1384 | 7971 | 700257574H1 | SATMON017 | g556559 | BLASTN | 724 | 1e−51 | 84 |
| 1385 | 7971 | 700258619H1 | SATMON017 | g556559 | BLASTN | 815 | 1e−64 | 87 |
| 1386 | 7971 | 700467927H1 | SATMON025 | g556559 | BLASTN | 924 | 1e−68 | 86 |
| 1387 | 7971 | 700471476H1 | SATMON025 | g556559 | BLASTN | 384 | 1e−21 | 82 |
| 1388 | 7971 | LIB3059-024-Q1-K1-E10 | LIB3059 | g556559 | BLASTN | 1196 | 1e−90 | 86 |
| 1389 | 8114 | 700018755H1 | SATMON001 | g2104681 | BLASTN | 120 | 1e−20 | 67 |
| 1390 | 8114 | 700019384H1 | SATMON001 | g2104681 | BLASTN | 126 | 1e−22 | 68 |
| 1391 | 8114 | 700172657H1 | SATMON013 | g2104680 | BLASTN | 254 | 1e−10 | 69 |
| 1392 | 8114 | 700430389H1 | SATMONN01 | g2104681 | BLASTN | 126 | 1e−18 | 71 |
| 1393 | 8114 | LIB3067-039-Q1-K1-E6 | LIB3067 | g2104681 | BLASTN | 126 | 1e−35 | 71 |
| 1394 | 8284 | 700425177H1 | SATMONN01 | g22192 | BLASTN | 307 | 1e−14 | 86 |
| 1395 | 8421 | 700208480H1 | SATMON016 | g2735839 | BLASTN | 714 | 1e−62 | 87 |
| 1396 | 8421 | 700476129H1 | SATMON025 | g2735839 | BLASTN | 518 | 1e−42 | 86 |
| 1397 | 9078 | 700048059H1 | SATMON003 | g292496 | BLASTN | 136 | 1e−20 | 48 |
| 1398 | 9302 | 700342985H1 | SATMON021 | g886400 | BLASTN | 773 | 1e−55 | 90 |
| 1399 | 9302 | 700353685H1 | SATMON024 | g886401 | BLASTN | 90 | 1e−21 | 97 |
| 1400 | 9302 | 700382528H1 | SATMON024 | g886400 | BLASTN | 474 | 1e−37 | 81 |
| 1401 | 9302 | 700612251H1 | SATMON022 | g886400 | BLASTN | 534 | 1e−35 | 83 |
| 1402 | 9467 | 700075256H1 | SATMON007 | g2443887 | BLASTN | 209 | 1e−30 | 61 |
| 1403 | 9467 | 700084183H1 | SATMON011 | g2443887 | BLASTN | 209 | 1e−30 | 61 |
| 1404 | 9467 | 700204326H1 | SATMON003 | g2443887 | BLASTN | 209 | 1e−30 | 61 |
| 1405 | 968 | 700103864H1 | SATMON010 | g556557 | BLASTN | 1203 | 1e−91 | 88 |
| 1406 | 968 | 700453731H1 | SATMON029 | g556557 | BLASTN | 634 | 1e−74 | 85 |
| 1407 | 9723 | 700095557H1 | SATMON008 | g2511745 | BLASTN | 139 | 1e−21 | 44 |
| 1408 | 9776 | 700047854H1 | SATMON003 | g2145358 | BLASTN | 155 | 1e−39 | 67 |
| 1409 | 9776 | 700345422H1 | SATMON021 | g2145358 | BLASTN | 155 | 1e−35 | 67 |

MAIZE OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 1410 | 98 | 700194593H1 | SATMON014 | g172637 | BLASTN | 270 | 1e-11 | 64 |
| 1411 | 98 | LIB3061-045-Q1-K1-H8 | LIB3061 | g172637 | BLASTN | 290 | 1e-13 | 61 |
| 1412 | 990 | 700098560H1 | SATMON009 | g2280528 | BLASTN | 62 | 1e-20 | 66 |
| 1413 | 990 | LIB3060-053-Q1-K1-G5 | LIB3060 | g1841475 | BLASTN | 117 | 1e-49 | 63 |
| 1414 | 995 | 700161808H1 | SATMON012 | g2702280 | BLASTN | 164 | 1e-31 | 50 |

MAIZE HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1415 | -700022075 | 700022075H1 | SATMON001 | g1008878 | BLASTN | 1125 | 1e-84 | 100 |
| 1416 | -700028403 | 700028403H1 | SATMON003 | g166754 | BLASTN | 139 | 1e-31 | 70 |
| 1417 | -700046411 | 700046411H1 | SATMON004 | g1143706 | BLASTN | 1205 | 1e-103 | 98 |
| 1418 | -700049842 | 700049842H1 | SATMON003 | g1143704 | BLASTN | 1396 | 1e-107 | 99 |
| 1419 | -700074975 | 700074975H1 | SATMON007 | g2935572 | BLASTN | 966 | 1e-71 | 84 |
| 1420 | -700083338 | 700083338H1 | SATMON011 | g1173621 | BLASTN | 495 | 1e-55 | 75 |
| 1421 | -700085788 | 700085788H1 | SATMON011 | g1173621 | BLASTN | 583 | 1e-39 | 73 |
| 1422 | -700087227 | 700087227H1 | SATMON011 | g2245130 | BLASTN | 135 | 1e-20 | 40 |
| 1423 | -700090023 | 700090023H1 | SATMON011 | g1143704 | BLASTN | 1088 | 1e-88 | 97 |
| 1424 | -700097968 | 700097968H1 | SATMON009 | g313253 | BLASTN | 48 | 1e-17 | 47 |
| 1425 | -700105961 | 700105961H1 | SATMON010 | g2464893 | BLASTN | 124 | 1e-24 | 53 |
| 1426 | -700106005 | 700106005H1 | SATMON010 | g1814424 | BLASTN | 238 | 1e-34 | 68 |
| 1427 | -700155766 | 700155766H1 | SATMON007 | g1648930 | BLASTN | 1103 | 1e-83 | 99 |
| 1428 | -700156878 | 700156878H1 | SATMON012 | g2935572 | BLASTN | 486 | 1e-31 | 81 |
| 1429 | -700164912 | 700164912H1 | SATMON013 | g349266 | BLASTN | 252 | 1e-10 | 71 |
| 1430 | -700165751 | 700165751H1 | SATMON013 | g22330 | BLASTN | 910 | 1e-66 | 100 |
| 1431 | -700168414 | 700168414H1 | SATMON013 | g22350 | BLASTN | 1158 | 1e-87 | 91 |
| 1432 | -700171978 | 700171978H1 | SATMON013 | g1648930 | BLASTN | 885 | 1e-64 | 100 |
| 1433 | -700172688 | 700172688H1 | SATMON013 | g1143704 | BLASTN | 1142 | 1e-86 | 98 |
| 1434 | -700173028 | 700173028H1 | SATMON013 | g1008878 | BLASTN | 313 | 1e-42 | 93 |
| 1435 | -700202132 | 700202132H1 | SATMON003 | g2244990 | BLASTN | 171 | 1e-25 | 82 |
| 1436 | -700210656 | 700210656H1 | SATMON016 | g349379 | BLASTN | 118 | 1e-28 | 82 |
| 1437 | -700215409 | 700215409H1 | SATMON016 | g1648930 | BLASTN | 1484 | 1e-114 | 98 |
| 1438 | -700215454 | 700215454H1 | SATMON016 | g1045043 | BLASTN | 491 | 1e-32 | 67 |
| 1439 | -700218764 | 700218764H1 | SATMON011 | g1143706 | BLASTN | 781 | 1e-56 | 97 |
| 1440 | -700219170 | 700219170H1 | SATMON011 | g2464893 | BLASTN | 377 | 1e-54 | 94 |
| 1441 | -700219660 | 700219660H1 | SATMON011 | g1173621 | BLASTN | 323 | 1e-40 | 76 |
| 1442 | -700219669 | 700219669H1 | SATMON011 | g1173622 | BLASTN | 281 | 1e-40 | 72 |
| 1443 | -700221310 | 700221310H1 | SATMON011 | g507220 | BLASTN | 233 | 1e-33 | 46 |
| 1444 | -700223225 | 700223225H1 | SATMON011 | g1143706 | BLASTN | 1290 | 1e-98 | 100 |
| 1445 | -700241610 | 700241610H1 | SATMON010 | g22330 | BLASTN | 294 | 1e-35 | 93 |
| 1446 | -700244303 | 700244303H1 | SATMON010 | g22330 | BLASTN | 557 | 1e-43 | 99 |
| 1447 | -700261794 | 700261794H1 | SATMON017 | g2935572 | BLASTN | 448 | 1e-42 | 82 |
| 1448 | -700263117 | 700263117H1 | SATMON017 | g1045044 | BLASTN | 169 | 1e-25 | 81 |
| 1449 | -700265365 | 700265365H1 | SATMON017 | g499164 | BLASTN | 223 | 1e-38 | 67 |
| 1450 | -700349657 | 700349657H1 | SATMON023 | g1143706 | BLASTN | 1106 | 1e-83 | 88 |
| 1451 | -700351961 | 700351961H1 | SATMON023 | g2522483 | BLASTN | 246 | 1e-12 | 76 |
| 1452 | -700355847 | 700355847H1 | SATMON024 | g1173621 | BLASTN | 862 | 1e-62 | 76 |
| 1453 | -700378702 | 700378702H1 | SATMON020 | g1648930 | BLASTN | 626 | 1e-99 | 97 |
| 1454 | -700379506 | 700379506H1 | SATMON020 | g1648930 | BLASTN | 268 | 1e-12 | 98 |
| 1455 | -700379734 | 700379734H1 | SATMON021 | g1173622 | BLASTN | 129 | 1e-19 | 47 |
| 1456 | -700421514 | 700421514H1 | SATMONN01 | g22330 | BLASTN | 193 | 1e-09 | 82 |
| 1457 | -700432368 | 700432368H1 | SATMONN01 | g1122533 | BLASTN | 76 | 1e-18 | 65 |
| 1458 | -700439251 | 700439251H1 | SATMON026 | g2529702 | BLASTN | 391 | 1e-28 | 71 |
| 1459 | -700447203 | 700447203H1 | SATMON027 | g2464893 | BLASTN | 123 | 1e-18 | 51 |
| 1460 | -700467939 | 700467939H1 | SATMON025 | g452519 | BLASTN | 160 | 1e-24 | 47 |
| 1461 | -700471940 | 700471940H1 | SATMON025 | g1814424 | BLASTN | 123 | 1e-33 | 54 |
| 1462 | -700474077 | 700474077H1 | SATMON025 | g1143704 | BLASTN | 270 | 1e-13 | 81 |
| 1463 | -700552169 | 700552169H1 | SATMON022 | g2464893 | BLASTN | 171 | 1e-25 | 39 |
| 1464 | -700552223 | 700552223H1 | SATMON022 | g1008878 | BLASTN | 530 | 1e-71 | 85 |
| 1465 | -700571166 | 700571166H1 | SATMON030 | g166754 | BLASTN | 95 | 1e-20 | 87 |
| 1466 | -700574329 | 700574329H2 | SATMON030 | g2244990 | BLASTN | 220 | 1e-35 | 57 |
| 1467 | -700574833 | 700574833H1 | SATMON030 | g1143706 | BLASTN | 1075 | 1e-132 | 100 |
| 1468 | -700581639 | 700581639H1 | SATMON031 | g22330 | BLASTN | 168 | 1e-11 | 93 |
| 1469 | -700611333 | 700611333H1 | SATMON022 | g507220 | BLASTN | 153 | 1e-23 | 46 |
| 1470 | -700615009 | 700615009H1 | SATMON033 | g2244990 | BLASTN | 190 | 1e-44 | 82 |
| 1471 | -700617943 | 700617943H1 | SATMON033 | g1173621 | BLASTN | 680 | 1e-69 | 79 |

-continued

MAIZE HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1472 | -701158775 | 701158775H1 | SATMONN04 | g22330 | BLASTN | 254 | 1e-22 | 95 |
| 1473 | -701169019 | 701169019H1 | SATMONN05 | g22330 | BLASTN | 191 | 1e-09 | 80 |
| 1474 | -701176830 | 701176830H1 | SATMONN05 | g1946221 | BLASTN | 706 | 1e-50 | 76 |
| 1475 | -701178369 | 701178369H1 | SATMONN05 | g1235564 | BLASTN | 331 | 1e-16 | 73 |
| 1476 | -701179971 | 701179971H1 | SATMONN05 | g1805615 | BLASTN | 234 | 1e-08 | 86 |
| 1477 | 11404 | 700094062H1 | SATMON008 | g22350 | BLASTN | 1085 | 1e-111 | 98 |
| 1478 | 11404 | 700164815H1 | SATMON013 | g22350 | BLASTN | 1027 | 1e-76 | 96 |
| 1479 | 11404 | 700166420H1 | SATMON013 | g22350 | BLASTN | 1258 | 1e-96 | 99 |
| 1480 | 11404 | 700169161H1 | SATMON013 | g22350 | BLASTN | 935 | 1e-82 | 100 |
| 1481 | 11418 | 700097291H1 | SATMON009 | g1122533 | BLASTN | 167 | 1e-24 | 72 |
| 1482 | 12291 | 700470110H1 | SATMON025 | g22330 | BLASTN | 675 | 1e-47 | 97 |
| 1483 | 12291 | 700578987H1 | SATMON031 | g22330 | BLASTN | 666 | 1e-46 | 97 |
| 1484 | 12817 | 700093049H1 | SATMON008 | g1143704 | BLASTN | 817 | 1e-59 | 98 |
| 1485 | 12817 | 700552210H1 | SATMON022 | g1143704 | BLASTN | 1174 | 1e-88 | 97 |
| 1486 | 12817 | 700553281H1 | SATMON022 | g1143704 | BLASTN | 266 | 1e-13 | 98 |
| 1487 | 12817 | 700574165H1 | SATMON030 | g1143704 | BLASTN | 836 | 1e-71 | 95 |
| 1488 | 13037 | 700073709H1 | SATMON007 | g1008878 | BLASTN | 944 | 1e-69 | 87 |
| 1489 | 13037 | 700282113H1 | SATMON022 | g1008878 | BLASTN | 576 | 1e-66 | 95 |
| 1490 | 13120 | 700263311H1 | SATMON017 | g2388574 | BLASTN | 91 | 1e-25 | 62 |
| 1491 | 13120 | 700267466H1 | SATMON017 | g1173622 | BLASTN | 70 | 1e-23 | 68 |
| 1492 | 1402 | 700048947H1 | SATMON003 | g2529702 | BLASTN | 496 | 1e-38 | 75 |
| 1493 | 1402 | 700074563H1 | SATMON007 | g2738464 | BLASTN | 104 | 1e-17 | 79 |
| 1494 | 1402 | 700450537H1 | SATMON028 | g2529702 | BLASTN | 475 | 1e-30 | 77 |
| 1495 | 1402 | 700617584H1 | SATMON033 | g2529702 | BLASTN | 442 | 1e-26 | 80 |
| 1496 | 1402 | 700621952H1 | SATMON034 | g2529702 | BLASTN | 418 | 1e-28 | 75 |
| 1497 | 14385 | 700085542H1 | SATMON011 | g2244990 | BLASTN | 139 | 1e-44 | 81 |
| 1498 | 15611 | 700215778H1 | SATMON016 | g309573 | BLASTN | 475 | 1e-30 | 77 |
| 1499 | 16940 | 700085254H1 | SATMON011 | g1008879 | BLASTN | 179 | 1e-32 | 59 |
| 1500 | 16940 | 700087804H1 | SATMON011 | g1008879 | BLASTN | 179 | 1e-26 | 70 |
| 1501 | 17209 | 700156405H1 | SATMON012 | g2244990 | BLASTN | 113 | 1e-17 | 80 |
| 1502 | 17209 | 700614092H1 | SATMON033 | g2244990 | BLASTN | 138 | 1e-21 | 71 |
| 1503 | 1831 | 700216393H1 | SATMON016 | g22330 | BLASTN | 412 | 1e-24 | 97 |
| 1504 | 19924 | 700090084H1 | SATMON011 | g2244990 | BLASTN | 208 | 1e-30 | 100 |
| 1505 | 19976 | LIB3062-028-Q1-K1-G3 | LIB3062 | g549891 | BLASTN | 175 | 1e-49 | 55 |
| 1506 | 19976 | LIB3067-036-Q1-K1-B12 | LIB3067 | g1435022 | BLASTN | 155 | 1e-39 | 68 |
| 1507 | 20055 | 700090163H1 | SATMON011 | g1814424 | BLASTN | 126 | 1e-24 | 52 |
| 1508 | 20560 | 700611944H1 | SATMON022 | g1008878 | BLASTN | 338 | 1e-17 | 72 |
| 1509 | 20560 | 700611959H1 | SATMON022 | g2522483 | BLASTN | 308 | 1e-20 | 77 |
| 1510 | 20838 | 700571750H1 | SATMON030 | g22330 | BLASTN | 1072 | 1e-95 | 96 |
| 1511 | 20838 | 700575750H1 | SATMON030 | g22330 | BLASTN | 949 | 1e-70 | 90 |
| 1512 | 21483 | LIB3062-043-Q1-K1-E7 | LIB3062 | g349267 | BLASTN | 82 | 1e-44 | 63 |
| 1513 | 21642 | 700552148H1 | SATMON022 | g2935572 | BLASTN | 854 | 1e-72 | 85 |
| 1514 | 21642 | 700582548H1 | SATMON031 | g2935572 | BLASTN | 844 | 1e-72 | 84 |
| 1515 | 21719 | 700169585H1 | SATMON013 | g1143706 | BLASTN | 1146 | 1e-86 | 99 |
| 1516 | 21719 | 700469049H1 | SATMON025 | g1143706 | BLASTN | 1432 | 1e-110 | 98 |
| 1517 | 22019 | 700027141H1 | SATMON003 | g1045041 | BLASTN | 565 | 1e-54 | 75 |
| 1518 | 22019 | 700163580H1 | SATMON013 | g1946222 | BLASTN | 120 | 1e-27 | 62 |
| 1519 | 22019 | LIB3078-024-Q1-K1-D11 | LIB3078 | g3116211 | BLASTN | 534 | 1e-50 | 79 |
| 1520 | 2277 | 700457038H1 | SATMON029 | g349266 | BLASTN | 429 | 1e-26 | 68 |
| 1521 | 2277 | 700457044H1 | SATMON029 | g349266 | BLASTN | 284 | 1e-30 | 72 |
| 1522 | 2277 | LIB3078-027-Q1-K1-D7 | LIB3078 | g349266 | BLASTN | 489 | 1e-31 | 71 |
| 1523 | 23635 | 701186070H1 | SATMONN06 | g16334 | BLASTN | 116 | 1e-26 | 72 |
| 1524 | 23635 | LIB143-059-Q1-E1-D6 | LIB143 | g349266 | BLASTN | 579 | 1e-39 | 75 |
| 1525 | 23635 | LIB3059-040-Q1-K1-B1 | LIB3059 | g166754 | BLASTN | 234 | 1e-52 | 64 |
| 1526 | 23983 | LIB3060-001-Q1-K2-A2 | LIB3060 | g499164 | BLASTN | 81 | 1e-33 | 74 |
| 1527 | 23983 | LB3060-002-Q1-K2-G9 | LIB3060 | g499163 | BLASTN | 501 | 1e-30 | 66 |
| 1528 | 23983 | LIB3060-002-Q1-K2-G10 | LIB3060 | g499163 | BLASTN | 443 | 1e-25 | 71 |
| 1529 | 25703 | 700094029H1 | SATMON008 | g1143706 | BLASTN | 730 | 1e-93 | 94 |
| 1530 | 25703 | 701161267H1 | SATMONN04 | g1143706 | BLASTN | 620 | 1e-42 | 95 |
| 1531 | 26329 | 700102662H1 | SATMON010 | g1143704 | BLASTN | 1670 | 1e-130 | 100 |
| 1532 | 26329 | 700222436H1 | SATMON011 | g1143706 | BLASTN | 1203 | 1e-91 | 99 |
| 1533 | 26329 | 700240490H1 | SATMON010 | g1143704 | BLASTN | 1396 | 1e-107 | 99 |
| 1534 | 26329 | LIB3069-017-Q1-K1-C7 | LIB3069 | g1143704 | BLASTN | 1653 | 1e-149 | 97 |
| 1535 | 26972 | 700261630H1 | SATMON017 | g1814424 | BLASTN | 266 | 1e-38 | 75 |

-continued

MAIZE HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1536 | 26972 | LIB84-004-Q1-E1-G12 | LIB84 | g1173621 | BLASTN | 564 | 1e−36 | 66 |
| 1537 | 28499 | 700022091H1 | SATMON001 | g22350 | BLASTN | 966 | 1e−71 | 98 |
| 1538 | 28499 | LIB3067-044-Q1-K1-G8 | LIB3067 | g22350 | BLASTN | 980 | 1e−76 | 95 |
| 1539 | 32276 | 700467151H1 | SATMON025 | g2244990 | BLASTN | 123 | 1e−36 | 71 |
| 1540 | 32758 | LIB189-021-Q1-E1-B1 | LIB189 | g1881536 | BLASTN | 142 | 1e−37 | 62 |
| 1541 | 3792 | 700207835H1 | SATMON016 | g1814424 | BLASTN | 264 | 1e−40 | 74 |
| 1542 | 3792 | 700474795H1 | SATMON025 | g1173622 | BLASTN | 102 | 1e−24 | 60 |
| 1543 | 5147 | 700049946H1 | SATMON003 | g2464893 | BLASTN | 233 | 1e−34 | 76 |
| 1544 | 5147 | 700089031H1 | SATMON011 | g2464893 | BLASTN | 306 | 1e−48 | 71 |
| 1545 | 5147 | 700089032H1 | SATMON011 | g1122533 | BLASTN | 215 | 1e−34 | 61 |
| 1546 | 6534 | 700073312H1 | SATMON007 | g1122532 | BLASTN | 440 | 1e−26 | 66 |
| 1547 | 6534 | 700377243H1 | SATMON019 | g2464893 | BLASTN | 226 | 1e−38 | 77 |
| 1548 | 7480 | 700071941H1 | SATMON007 | g1143704 | BLASTN | 1450 | 1e−115 | 98 |
| 1549 | 7480 | 700281684H1 | SATMON011 | g1143704 | BLASTN | 1365 | 1e−104 | 100 |
| 1550 | 7480 | 700548984H1 | SATMON022 | g1143704 | BLASTN | 1320 | 1e−102 | 97 |
| 1551 | 7480 | 700576352H1 | SATMON030 | g1143704 | BLASTN | 523 | 1e−71 | 94 |
| 1552 | 7480 | 700581679H1 | SATMON031 | g1143704 | BLASTN | 766 | 1e−73 | 99 |
| 1553 | 7480 | 700616428H1 | SATMON033 | g1143704 | BLASTN | 690 | 1e−87 | 92 |
| 1554 | 8104 | 700441126H1 | SATMON026 | g2464893 | BLASTN | 225 | 1e−33 | 52 |
| 1555 | 8104 | 700444259H1 | SATMON027 | g2464893 | BLASTN | 115 | 1e−17 | 54 |

MAIZE LEUCINE ZIPPER TRANSCRIPTION FACTOR

| Seq No. | Cluster ID | CloneID | Library | NCBI gi | METHOD | Score | P-Value | % Ident |
|---|---|---|---|---|---|---|---|---|
| 1556 | -700026759 | 700026759H1 | SATMON003 | g2317905 | BLASTN | 101 | 1e−20 | 38 |
| 1557 | -700043856 | 700043856H1 | SATMON004 | g1052959 | BLASTN | 236 | 1e−08 | 84 |
| 1558 | -700045214 | 700045214H1 | SATMON004 | g1052959 | BLASTN | 344 | 1e−18 | 76 |
| 1559 | -700051334 | 700051334H1 | SATMON003 | g21635 | BLASTN | 89 | 1e−20 | 80 |
| 1560 | -700052422 | 700052422H1 | SATMON003 | g414613 | BLASTN | 141 | 1e−26 | 73 |
| 1561 | -700073288 | 700073288H1 | SATMON007 | g2253277 | BLASTN | 185 | 1e−08 | 82 |
| 1562 | -700076538 | 700076538H1 | SATMON007 | g2291143 | BLASTN | 138 | 1e−23 | 39 |
| 1563 | -700082003 | 700082003H1 | SATMON011 | g790575 | BLASTN | 123 | 1e−18 | 53 |
| 1564 | -700085627 | 700085627H1 | SATMON011 | g394735 | BLASTN | 261 | 1e−10 | 63 |
| 1565 | -700086363 | 700086363H1 | SATMON011 | g2651296 | BLASTN | 134 | 1e−20 | 36 |
| 1566 | -700088669 | 700088669H1 | SATMON011 | g2281449 | BLASTN | 100 | 1e−22 | 74 |
| 1567 | -700090111 | 700090111H1 | SATMON011 | g16429 | BLASTN | 123 | 1e−21 | 60 |
| 1568 | -700100046 | 700100046H1 | SATMON009 | g19275 | BLASTN | 215 | 1e−31 | 39 |
| 1569 | -700101881 | 700101881H1 | SATMON009 | g19275 | BLASTN | 189 | 1e−28 | 42 |
| 1570 | -700103640 | 700103640H1 | SATMON010 | g2921823 | BLASTN | 124 | 1e−19 | 74 |
| 1571 | -700104159 | 700104159H1 | SATMON010 | g2865393 | BLASTN | 293 | 1e−13 | 75 |
| 1572 | -700151219 | 700151219H1 | SATMON007 | g2317905 | BLASTN | 125 | 1e−19 | 53 |
| 1573 | -700154149 | 700154149H1 | SATMON007 | g435941 | BLASTN | 240 | 1e−11 | 87 |
| 1574 | -700154895 | 700154895H1 | SATMON007 | g19275 | BLASTN | 139 | 1e−21 | 38 |
| 1575 | -700172865 | 700172865H1 | SATMON013 | g2253277 | BLASTN | 670 | 1e−47 | 76 |
| 1576 | -700195674 | 700195674H1 | SATMON014 | g21634 | BLASTN | 428 | 1e−25 | 81 |
| 1577 | -700197522 | 700197522H1 | SATMON014 | g19275 | BLASTN | 174 | 1e−25 | 56 |
| 1578 | -700208483 | 700208483H1 | SATMON016 | g19275 | BLASTN | 104 | 1e−25 | 36 |
| 1579 | -700211494 | 700211494H1 | SATMON016 | g435941 | BLASTN | 564 | 1e−38 | 84 |
| 1580 | -700216833 | 700216833H1 | SATMON016 | g19275 | BLASTN | 101 | 1e−19 | 39 |
| 1581 | -700221766 | 700221766H1 | SATMON011 | g2253278 | BLASTN | 150 | 1e−22 | 74 |
| 1582 | -700224641 | 700224641H1 | SATMON011 | g2317905 | BLASTN | 109 | 1e−22 | 41 |
| 1583 | -700224775 | 700224775H1 | SATMON011 | g600855 | BLASTN | 115 | 1e−17 | 39 |
| 1584 | -700237947 | 700237947H1 | SATMON010 | g19275 | BLASTN | 172 | 1e−25 | 54 |
| 1585 | -700238972 | 700238972H1 | SATMON010 | g21634 | BLASTN | 517 | 1e−60 | 80 |
| 1586 | -700263988 | 700263988H1 | SATMON017 | g2253278 | BLASTN | 133 | 1e−20 | 38 |
| 1587 | -700265544 | 700265544H1 | SATMON017 | g19275 | BLASTN | 74 | 1e−19 | 40 |
| 1588 | -700337561 | 700337561H1 | SATMON020 | g21634 | BLASTN | 228 | 1e−13 | 83 |
| 335 | -700341946 | 700341946H1 | SATMON020 | g2104677 | BLASTN | 97 | 1e−28 | 60 |
| 1589 | -700349755 | 700349755H1 | SATMON023 | g435941 | BLASTN | 450 | 1e−47 | 82 |
| 1590 | -700447061 | 700447061H1 | SATMON027 | g435941 | BLASTN | 436 | 1e−63 | 89 |
| 1591 | -700448554 | 700448554H1 | SATMON028 | g292447 | BLASTN | 102 | 1e−27 | 66 |
| 1592 | -700474347 | 700474347H1 | SATMON025 | g1147631 | BLASTN | 477 | 1e−39 | 79 |
| 1593 | -700617187 | 700617187H1 | SATMON033 | g1147631 | BLASTN | 403 | 1e−24 | 81 |
| 1594 | -700621840 | 700621840H1 | SATMON034 | g2246376 | BLASTN | 96 | 1e−25 | 67 |
| 1595 | -700803395 | 700803395H1 | SATMON036 | g22383 | BLASTN | 311 | 1e−33 | 98 |
| 1596 | -700803857 | 700803857H1 | SATMON036 | g22383 | BLASTN | 539 | 1e−61 | 96 |

-continued

MAIZE LEUCINE ZIPPER TRANSCRIPTION FACTOR

| Seq No. | Cluster ID | CloneID | Library | NCBI gi | METHOD | Score | P-Value | % Ident |
|---|---|---|---|---|---|---|---|---|
| 1597 | -700804349 | 700804349H1 | SATMON036 | g22383 | BLASTN | 276 | 1e-31 | 90 |
| 1598 | -701167790 | 701167790H1 | SATMONN05 | g2865393 | BLASTN | 768 | 1e-55 | 77 |
| 1599 | -701168742 | 701168742H1 | SATMONN05 | g2865393 | BLASTN | 488 | 1e-31 | 68 |
| 1600 | -701173087 | 701173087H2 | SATMONN05 | g2281448 | BLASTN | 356 | 1e-18 | 74 |
| 1475 | -701178369 | 701178369H1 | SATMONN05 | g1235564 | BLASTN | 331 | 1e-16 | 73 |
| 1601 | -701181780 | 701181780H1 | SATMONN06 | g1783305 | BLASTN | 126 | 1e-19 | 55 |
| 1602 | 10022 | LIB3078-012-Q1-K1-H4 | LIB3078 | g2959559 | BLASTN | 93 | 1e-37 | 46 |
| 1603 | 10491 | 700095022H1 | SATMON008 | g2921822 | BLASTN | 744 | 1e-53 | 72 |
| 1604 | 10491 | 700205717H1 | SATMON003 | g2921822 | BLASTN | 693 | 1e-48 | 73 |
| 1605 | 10491 | 700258018H1 | SATMON017 | g2921822 | BLASTN | 683 | 1e-48 | 73 |
| 1606 | 11184 | 700026566H1 | SATMON003 | g19275 | BLASTN | 136 | 1e-23 | 36 |
| 1607 | 11184 | 700167820H1 | SATMON013 | g19275 | BLASTN | 136 | 1e-21 | 36 |
| 1608 | 11184 | 700170288H1 | SATMON013 | g19275 | BLASTN | 130 | 1e-19 | 33 |
| 1609 | 11184 | LIB3059-023-Q1-K1-E11 | LIB3059 | g19275 | BLASTN | 146 | 1e-40 | 40 |
| 1610 | 11184 | LIB3066-021-Q1-K1-H6 | LIB3066 | g19275 | BLASTN | 171 | 1e-57 | 43 |
| 1611 | 12153 | 700461111H1 | SATMON033 | g600855 | BLASTN | 156 | 1e-23 | 39 |
| 1612 | 12866 | 700551880H1 | SATMON022 | g435941 | BLASTN | 337 | 1e-43 | 80 |
| 1613 | 12866 | 700579217H1 | SATMON031 | g435941 | BLASTN | 635 | 1e-71 | 88 |
| 1614 | 13159 | 700381959H1 | SATMON023 | g2253278 | BLASTN | 93 | 1e-19 | 83 |
| 1615 | 13855 | 700092464H1 | SATMON008 | g2564278 | BLASTN | 115 | 1e-17 | 24 |
| 1616 | 14112 | 700082712H1 | SATMON011 | g600855 | BLASTN | 159 | 1e-23 | 34 |
| 1617 | 14112 | 700088489H1 | SATMON011 | g600855 | BLASTN | 168 | 1e-25 | 39 |
| 1618 | 15173 | 700577567H1 | SATMON031 | g435941 | BLASTN | 609 | 1e-41 | 84 |
| 1619 | 15173 | 700622606H1 | SATMON034 | g435941 | BLASTN | 411 | 1e-35 | 82 |
| 1620 | 15365 | 700569809H1 | SATMON030 | g19275 | BLASTN | 294 | 1e-47 | 52 |
| 1621 | 15877 | 700577006H1 | SATMON031 | g1033195 | BLASTN | 124 | 1e-19 | 88 |
| 1622 | 16241 | LIB3062-019-Q1-K1-G1 | LIB3062 | g19275 | BLASTN | 142 | 1e-47 | 35 |
| 1623 | 17029 | 700099008H1 | SATMON009 | g1060934 | BLASTN | 237 | 1e-10 | 94 |
| 1624 | 17029 | 700102025H1 | SATMON010 | g1060934 | BLASTN | 698 | 1e-75 | 85 |
| 1625 | 17029 | 700165819H1 | SATMON013 | g1060934 | BLASTN | 550 | 1e-37 | 91 |
| 1626 | 17029 | 700168474H1 | SATMON013 | g1060934 | BLASTN | 443 | 1e-28 | 86 |
| 1627 | 17029 | 700171701H1 | SATMON013 | g1060934 | BLASTN | 781 | 1e-56 | 88 |
| 1628 | 17029 | LIB143-011-Q1-E1-H5 | LIB143 | g1060934 | BLASTN | 1165 | 1e-107 | 96 |
| 1629 | 17029 | LIB3060-006-Q1-K1-C10 | LIB3060 | g1060934 | BLASTN | 1316 | 1e-123 | 87 |
| 1630 | 17029 | LIB3060-046-Q1-K1-B2 | LIB3060 | g1060934 | BLASTN | 1522 | 1e-145 | 91 |
| 1631 | 17891 | 700018093H1 | SATMON001 | g19275 | BLASTN | 118 | 1e-23 | 69 |
| 1632 | 17891 | 700550775H1 | SATMON022 | g19275 | BLASTN | 152 | 1e-35 | 64 |
| 1633 | 17891 | LIB143-027-Q1-E1-C10 | LIB143 | g19275 | BLASTN | 109 | 1e-34 | 73 |
| 1634 | 18790 | 700083176H1 | SATMON011 | g19275 | BLASTN | 245 | 1e-35 | 44 |
| 1635 | 18790 | 700218787H1 | SATMON011 | g19275 | BLASTN | 188 | 1e-27 | 40 |
| 1506 | 19976 | LIB3067-036-Q1-K1-B12 | LIB3067 | g1435022 | BLASTN | 155 | 1e-39 | 68 |
| 1636 | 20163 | LIB3061-037-Q1-K1-G8 | LIB3061 | g22383 | BLASTN | 449 | 1e-104 | 86 |
| 1637 | 20233 | 700084065H1 | SATMON011 | g1060934 | BLASTN | 1396 | 1e-107 | 99 |
| 1638 | 20233 | 700167866H1 | SATMON013 | g1060934 | BLASTN | 1040 | 1e-77 | 100 |
| 1639 | 20233 | 701168486H1 | SATMONN05 | g1060934 | BLASTN | 996 | 1e-74 | 99 |
| 1640 | 20966 | 700153842H1 | SATMON007 | g600854 | BLASTN | 562 | 1e-38 | 72 |
| 1641 | 20966 | 701159849H1 | SATMONN04 | g600855 | BLASTN | 178 | 1e-39 | 72 |
| 1642 | 20966 | 701181355H1 | SATMONN06 | g600855 | BLASTN | 182 | 1e-36 | 63 |
| 1643 | 2233 | 700044102H1 | SATMON004 | g1033194 | BLASTN | 951 | 1e-70 | 84 |
| 1644 | 2233 | 700045607H1 | SATMON004 | g1033194 | BLASTN | 986 | 1e-73 | 82 |
| 1645 | 2233 | 700046019H1 | SATMON004 | g1052959 | BLASTN | 810 | 1e-58 | 76 |
| 1646 | 2233 | 700097636H1 | SATMON009 | g1052959 | BLASTN | 726 | 1e-77 | 80 |
| 1647 | 2233 | 700098421H1 | SATMON009 | g1052959 | BLASTN | 492 | 1e-46 | 78 |
| 1648 | 2233 | 700167584H1 | SATMON013 | g1052959 | BLASTN | 742 | 1e-53 | 81 |
| 1649 | 2233 | 700214820H1 | SATMON016 | g1052959 | BLASTN | 720 | 1e-51 | 80 |
| 1650 | 2233 | 700215075H1 | SATMON016 | g1052959 | BLASTN | 783 | 1e-56 | 76 |
| 1651 | 2233 | 700217212H1 | SATMON016 | g1052960 | BLASTN | 246 | 1e-36 | 82 |
| 1652 | 2233 | 700422645H1 | SATMONN01 | g1052959 | BLASTN | 454 | 1e-29 | 72 |
| 1653 | 2233 | 700423383H1 | SATMONN01 | g1052960 | BLASTN | 102 | 1e-33 | 91 |
| 1654 | 2233 | 700424963H1 | SATMONN01 | g1052959 | BLASTN | 506 | 1e-33 | 79 |
| 1655 | 2233 | 700425938H1 | SATMONN01 | g1052960 | BLASTN | 134 | 1e-20 | 81 |
| 1656 | 2233 | 700426188H1 | SATMONN01 | g1052960 | BLASTN | 178 | 1e-26 | 68 |
| 1657 | 2233 | 700430714H1 | SATMONN01 | g1052959 | BLASTN | 617 | 1e-42 | 79 |
| 1658 | 2233 | 700438641H1 | SATMON026 | g1033194 | BLASTN | 594 | 1e-40 | 81 |
| 1659 | 2233 | 700439768H1 | SATMON026 | g1033194 | BLASTN | 385 | 1e-28 | 81 |

-continued

MAIZE LEUCINE ZIPPER TRANSCRIPTION FACTOR

| Seq No. | Cluster ID | CloneID | Library | NCBI gi | METHOD | Score | P-Value | % Ident |
|---|---|---|---|---|---|---|---|---|
| 1660 | 2233 | 700460877H1 | SATMON031 | g1052960 | BLASTN | 108 | 1e−18 | 87 |
| 1661 | 2233 | 700578130H1 | SATMON031 | g1033194 | BLASTN | 469 | 1e−29 | 64 |
| 1662 | 2233 | 700582130H1 | SATMON031 | g1052959 | BLASTN | 682 | 1e−48 | 73 |
| 1663 | 2233 | LIB189-002-Q1-E1-C1 | LIB189 | g1033194 | BLASTN | 1393 | 1e−107 | 82 |
| 1664 | 2233 | LIB3060-008-Q1-K1-A3 | LIB3060 | g1033194 | BLASTN | 761 | 1e−52 | 78 |
| 1665 | 2233 | LIB3067-039-Q1-K1-G12 | LIB3067 | g1033194 | BLASTN | 1448 | 1e−111 | 81 |
| 1666 | 2233 | LIB3068-043-Q1-K1-G9 | LIB3068 | g1033194 | BLASTN | 962 | 1e−82 | 76 |
| 1667 | 2233 | LIB36-010-Q1-E1-D5 | LIB36 | g1052959 | BLASTN | 1210 | 1e−92 | 79 |
| 1668 | 2233 | LIB84-027-Q1-E1-E12 | LIB84 | g1052959 | BLASTN | 1013 | 1e−87 | 80 |
| 1669 | 22540 | 700352565H1 | SATMON023 | g1753084 | BLASTN | 464 | 1e−31 | 75 |
| 1670 | 22540 | 700577189H1 | SATMON031 | g1753085 | BLASTN | 93 | 1e−19 | 75 |
| 1671 | 22540 | LIB3069-023-Q1-K1-H5 | LIB3069 | g1753084 | BLASTN | 264 | 1e−10 | 78 |
| 1523 | 23635 | 701186070H1 | SATMONN06 | g16334 | BLASTN | 116 | 1e−26 | 72 |
| 1672 | 23923 | 700211157H1 | SATMON016 | g1122224 | BLASTN | 577 | 1e−38 | 66 |
| 1673 | 23923 | 701176447H1 | SATMONN05 | g1905785 | BLASTN | 211 | 1e−30 | 70 |
| 1674 | 24378 | LIB3069-035-Q1-K1-E11 | LIB3069 | g21632 | BLASTN | 779 | 1e−75 | 83 |
| 1675 | 2463 | 700019837H1 | SATMON001 | g21634 | BLASTN | 584 | 1e−39 | 85 |
| 1676 | 2463 | 700085128H1 | SATMON011 | g21634 | BLASTN | 452 | 1e−28 | 80 |
| 1677 | 2463 | 700092347H1 | SATMON008 | g21634 | BLASTN | 399 | 1e−22 | 83 |
| 1678 | 2463 | 700093882H1 | SATMON008 | g21634 | BLASTN | 399 | 1e−22 | 83 |
| 1679 | 2463 | 700153109H1 | SATMON007 | g21634 | BLASTN | 738 | 1e−52 | 82 |
| 1680 | 2463 | 700157835H1 | SATMON012 | g21634 | BLASTN | 407 | 1e−44 | 80 |
| 1681 | 2463 | 700170639H1 | SATMON013 | g21634 | BLASTN | 203 | 1e−29 | 78 |
| 1682 | 2463 | 700201241H1 | SATMON003 | g21634 | BLASTN | 333 | 1e−39 | 77 |
| 1683 | 2463 | 700236219H1 | SATMON010 | g21634 | BLASTN | 555 | 1e−52 | 78 |
| 1684 | 2463 | 700239860H1 | SATMON010 | g21634 | BLASTN | 900 | 1e−66 | 84 |
| 1685 | 2463 | 700337536H1 | SATMON020 | g21634 | BLASTN | 479 | 1e−29 | 83 |
| 1686 | 2463 | 700339949H1 | SATMON020 | g21634 | BLASTN | 717 | 1e−66 | 79 |
| 1687 | 2463 | 700340335H1 | SATMON020 | g21634 | BLASTN | 466 | 1e−28 | 82 |
| 1688 | 2463 | 700468441H1 | SATMON025 | g21634 | BLASTN | 855 | 1e−62 | 82 |
| 1689 | 2463 | 700574925H1 | SATMON030 | g21634 | BLASTN | 368 | 1e−21 | 86 |
| 1690 | 2463 | 700577228H1 | SATMON031 | g21634 | BLASTN | 931 | 1e−68 | 82 |
| 1691 | 2463 | 700579628H1 | SATMON031 | g21634 | BLASTN | 529 | 1e−63 | 83 |
| 1692 | 2463 | 700623187H1 | SATMON034 | g21634 | BLASTN | 679 | 1e−57 | 79 |
| 1693 | 2463 | LIB143-009-Q1-E1-H7 | LIB143 | g21634 | BLASTN | 522 | 1e−65 | 84 |
| 1694 | 2463 | LIB143-009-Q1-E1-H8 | LIB143 | g21634 | BLASTN | 649 | 1e−45 | 73 |
| 1695 | 2463 | LIB3066-023-Q1-K1-H9 | LIB3066 | g21634 | BLASTN | 449 | 1e−26 | 81 |
| 1696 | 2463 | LIB3078-004-Q1-K1-H6 | LIB3078 | g21634 | BLASTN | 398 | 1e−33 | 73 |
| 1697 | 26326 | LIB3062-051-Q1-K1-A2 | LIB3062 | g2959559 | BLASTN | 75 | 1e−34 | 61 |
| 1698 | 26326 | LIB3069-050-Q1-K1-G8 | LIB3069 | g2959559 | BLASTN | 87 | 1e−52 | 54 |
| 1699 | 26326 | LIB3078-004-Q1-K1-C5 | LIB3078 | g2959559 | BLASTN | 87 | 1e−52 | 53 |
| 1700 | 26872 | LIB3059-042-Q1-K1-A5 | LIB3059 | g1060934 | BLASTN | 1193 | 1e−116 | 92 |
| 1701 | 26872 | LIB3059-035-Q1-K1-D9 | LIB3059 | g1060934 | BLASTN | 1407 | 1e−136 | 88 |
| 1702 | 27311 | 700618712H1 | SATMON034 | g19275 | BLASTN | 176 | 1e−26 | 37 |
| 1703 | 27311 | LIB3066-025-Q1-K1-A10 | LIB3066 | g19275 | BLASTN | 147 | 1e−36 | 36 |
| 1704 | 2795 | 700048240H1 | SATMON003 | g2281449 | BLASTN | 125 | 1e−30 | 72 |
| 1705 | 29678 | 700170080H1 | SATMON013 | g21634 | BLASTN | 439 | 1e−51 | 78 |
| 1706 | 29678 | 700426193H1 | SATMONN01 | g21635 | BLASTN | 98 | 1e−22 | 67 |
| 1707 | 29791 | LIB3059-019-Q1-K1-B10 | LIB3059 | g21634 | BLASTN | 971 | 1e−80 | 86 |
| 1708 | 30792 | LIB143-040-Q1-E1-F3 | LIB143 | g1753086 | BLASTN | 268 | 1e−38 | 77 |
| 1709 | 30792 | LIB3059-056-Q1-K1-A5 | LIB3059 | g1753086 | BLASTN | 268 | 1e−28 | 78 |
| 1710 | 398 | 700622334H1 | SATMON034 | g1769891 | BLASTN | 86 | 1e−21 | 46 |
| 1711 | 398 | 700623777H1 | SATMON034 | g1769891 | BLASTN | 151 | 1e−23 | 46 |
| 1712 | 4953 | 700096885H1 | SATMON008 | g19275 | BLASTN | 108 | 1e−21 | 39 |

MAIZE LEUCINE ZIPPER TRANSCRIPTION FACTOR

| Seq No. | Cluster ID | CloneID | Library | NCBI gi | METHOD | Score | P-Value | % Ident |
|---|---|---|---|---|---|---|---|---|
| 1713 | 4953 | 700173030H1 | SATMON013 | g19275 | BLASTN | 167 | 1e-24 | 42 |
| 1714 | 4953 | 700221793H1 | SATMON011 | g19275 | BLASTN | 192 | 1e-28 | 40 |
| 1715 | 4953 | 700580086H1 | SATMON031 | g19275 | BLASTN | 159 | 1e-23 | 36 |
| 1716 | 6037 | 700095735H1 | SATMON008 | g19275 | BLASTN | 269 | 1e-39 | 51 |
| 1717 | 6037 | 700095783H1 | SATMON008 | g19275 | BLASTN | 264 | 1e-38 | 51 |
| 1718 | 6336 | 700102843H1 | SATMON010 | g1753086 | BLASTN | 226 | 1e-14 | 87 |
| 1719 | 6336 | 700105032H1 | SATMON010 | g1753086 | BLASTN | 226 | 1e-25 | 84 |
| 1720 | 6336 | LIB3059-013-Q1-K1-B5 | LIB3059 | g1753086 | BLASTN | 245 | 1e-22 | 81 |
| 1721 | 6336 | LIB3061-035-Q1-K1-A12 | LIB3061 | g1753086 | BLASTN | 236 | 1e-21 | 79 |
| 1722 | 6336 | LIB3061-031-Q1-K1-A4 | LIB3061 | g1753086 | BLASTN | 236 | 1e-21 | 80 |
| 1723 | 6336 | LIB3061-043-Q1-K1-B10 | LIB3061 | g1753086 | BLASTN | 236 | 1e-16 | 80 |

MAIZE HLH TRANSCRIPTION FACTORS

| Seq No. | Cluster ID | CloneID | Library | NCBI gi | METHOD | Score | P-Value | % Ident |
|---|---|---|---|---|---|---|---|---|
| 1724 | -700030417 | 700030417H1 | SATMON003 | g1477749 | BLASTN | 42 | 1e-17 | 51 |
| 1725 | -700151401 | 700151401H1 | SATMON007 | g22478 | BLASTN | 1118 | 1e-84 | 98 |
| 1726 | -700171510 | 700171510H1 | SATMON013 | g1142621 | BLASTN | 119 | 1e-18 | 59 |
| 1727 | -700171659 | 700171659H1 | SATMON013 | g2351072 | BLASTN | 245 | 1e-11 | 70 |
| 1728 | -700205626 | 700205626H1 | SATMON003 | g1465368 | BLASTN | 97 | 1e-21 | 75 |
| 1729 | -700342458 | 700342458H1 | SATMON021 | g1142619 | BLASTN | 128 | 1e-19 | 58 |
| 1730 | -700344859 | 700344859H1 | SATMON021 | g1575534 | BLASTN | 133 | 1e-20 | 52 |
| 1731 | -700428022 | 700428022H1 | SATMONN01 | g2351072 | BLASTN | 293 | 1e-13 | 65 |
| 1732 | -700574126 | 700574126H1 | SATMON030 | g2842468 | BLASTN | 173 | 1e-33 | 56 |
| 1733 | -700801387 | 700801387H1 | SATMON036 | g1142621 | BLASTN | 124 | 1e-19 | 51 |
| 1734 | 13465 | 700204307H1 | SATMON003 | g1142621 | BLASTN | 126 | 1e-20 | 36 |
| 1735 | 13465 | 700205715H1 | SATMON003 | g1142621 | BLASTN | 116 | 1e-18 | 39 |
| 1736 | 14163 | 700045811H1 | SATMON004 | g2351072 | BLASTN | 382 | 1e-21 | 69 |
| 1737 | 14163 | 700222784H1 | SATMON011 | g2351072 | BLASTN | 373 | 1e-22 | 69 |
| 1738 | 31730 | LIB3066-012-Q1-K1-B6 | LIB3066 | g1142619 | BLASTN | 54 | 1e-33 | 55 |
| 1739 | 32755 | LIB189-008-Q1-E1-D8 | LIB189 | g1142619 | BLASTN | 141 | 1e-43 | 49 |
| 1740 | 459 | 700577179H1 | SATMON031 | g431265 | BLASTN | 188 | 1e-09 | 80 |
| 1741 | 8305 | 700027525H1 | SATMON003 | g1465367 | BLASTN | 211 | 1e-15 | 72 |
| 1742 | 8305 | 700206468H1 | SATMON003 | g1465367 | BLASTN | 263 | 1e-19 | 72 |
| 1743 | 8305 | 700214194H1 | SATMON016 | g1465367 | BLASTN | 170 | 1e-10 | 73 |
| 1744 | 8305 | 700453272H1 | SATMON028 | g1465367 | BLASTN | 209 | 1e-15 | 72 |
| 1745 | 8305 | LIB143-037-Q1-E1-E3 | LIB143 | g1465367 | BLASTN | 298 | 1e-21 | 73 |

SOYBEAN HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1746 | -700555559 | 700555559H1 | SOYMON001 | g1173621 | BLASTN | 439 | 1e-26 | 72 |
| 1747 | -700560219 | 700560219H1 | SOYMON001 | g1173622 | BLASTN | 141 | 1e-29 | 53 |
| 1748 | -700565743 | 700565743H1 | SOYMON002 | g2464893 | BLASTN | 98 | 1e-17 | 45 |
| 1749 | -700649042 | 700649042H1 | SOYMON003 | g533708 | BLASTN | 598 | 1e-39 | 75 |
| 1750 | -700651436 | 700651436H1 | SOYMON003 | g606952 | BLASTN | 171 | 1e-31 | 59 |
| 1751 | -700654022 | 700654022H1 | SOYMON003 | g549886 | BLASTN | 56 | 1e-17 | 60 |
| 1752 | -700659382 | 700659382H1 | SOYMON004 | g1435021 | BLASTN | 102 | 1e-20 | 42 |
| 1753 | -700663176 | 700663176H1 | SOYMON005 | g1814423 | BLASTN | 572 | 1e-38 | 75 |
| 1754 | -700664572 | 700664572H1 | SOYMON005 | g1814424 | BLASTN | 91 | 1e-18 | 64 |
| 1755 | -700665913 | 700665913H1 | SOYMON005 | g507219 | BLASTN | 240 | 1e-16 | 64 |
| 1756 | -700667947 | 700667947H1 | SOYMON006 | g507797 | BLASTN | 560 | 1e-49 | 75 |
| 1757 | -700673793 | 700673793H1 | SOYMON007 | g930065 | BLASTN | 41 | 1e-18 | 47 |
| 1758 | -700676275 | 700676275H1 | SOYMON007 | g1946221 | BLASTN | 865 | 1e-63 | 80 |
| 1759 | -700684289 | 700684289H1 | SOYMON008 | g1122533 | BLASTN | 80 | 1e-17 | 59 |
| 1760 | -700725464 | 700725464H1 | SOYMON009 | g16019 | BLASTN | 274 | 1e-22 | 74 |
| 1761 | -700747348 | 700747348H1 | SOYMON013 | g453949 | BLASTN | 261 | 1e-46 | 72 |

-continued

SOYBEAN HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1762 | -700791930 | 700791930H1 | SOYMON011 | g1814424 | BLASTN | 110 | 1e-25 | 73 |
| 1763 | -700792664 | 700792664H1 | SOYMON017 | g2464893 | BLASTN | 144 | 1e-21 | 50 |
| 1764 | -700829533 | 700829533H1 | SOYMON019 | g767699 | BLASTN | 634 | 1e-44 | 83 |
| 1765 | -700833881 | 700833881H1 | SOYMON019 | g2464893 | BLASTN | 170 | 1e-28 | 55 |
| 1766 | -700839629 | 700839629H1 | SOYMON020 | g1122532 | BLASTN | 538 | 1e-35 | 70 |
| 1767 | -700843769 | 700843769H1 | SOYMON021 | g527628 | BLASTN | 631 | 1e-43 | 79 |
| 1768 | -700845147 | 700845147H1 | SOYMON021 | g349379 | BLASTN | 138 | 1e-25 | 80 |
| 1769 | -700853988 | 700853988H1 | SOYMON023 | g1173829 | BLASTN | 454 | 1e-28 | 74 |
| 1770 | -700854082 | 700854082H1 | SOYMON023 | g1881536 | BLASTN | 113 | 1e-21 | 62 |
| 1771 | -700869580 | 700869580H1 | SOYMON016 | g767697 | BLASTN | 292 | 1e-21 | 66 |
| 1772 | -700872483 | 700872483H1 | SOYMON018 | g1045041 | BLASTN | 312 | 1e-29 | 83 |
| 1773 | -700890624 | 700890624H1 | SOYMON024 | g2244990 | BLASTN | 166 | 1e-24 | 80 |
| 1774 | -700893192 | 700893192H1 | SOYMON024 | g767697 | BLASTN | 596 | 1e-40 | 76 |
| 1775 | -700893942 | 700893942H1 | SOYMON024 | g2464893 | BLASTN | 159 | 1e-25 | 52 |
| 1776 | -700893970 | 700893970H1 | SOYMON024 | g1008878 | BLASTN | 424 | 1e-26 | 66 |
| 1777 | -700894248 | 700894248H1 | SOYMON024 | g666128 | BLASTN | 181 | 1e-26 | 66 |
| 1778 | -700904909 | 700904909H1 | SOYMON022 | g453948 | BLASTN | 485 | 1e-31 | 81 |
| 1779 | -700908207 | 700908207H1 | SOYMON022 | g2244990 | BLASTN | 131 | 1e-28 | 80 |
| 1780 | -700910094 | 700910094H1 | SOYMON022 | g533708 | BLASTN | 765 | 1e-59 | 81 |
| 1781 | -700942657 | 700942657H1 | SOYMON024 | g310568 | BLASTN | 652 | 1e-72 | 85 |
| 1782 | -700943207 | 700943207H1 | SOYMON024 | g1881536 | BLASTN | 131 | 1e-31 | 59 |
| 1783 | -700943363 | 700943363H1 | SOYMON024 | g310568 | BLASTN | 412 | 1e-43 | 87 |
| 1784 | -700945149 | 700945149H1 | SOYMON024 | g310568 | BLASTN | 618 | 1e-52 | 94 |
| 1785 | -700953112 | 700953112H1 | SOYMON022 | g2464893 | BLASTN | 131 | 1e-19 | 68 |
| 1786 | -700954444 | 700954444H1 | SOYMON022 | g2388574 | BLASTN | 114 | 1e-17 | 100 |
| 1787 | -700957315 | 700957315H1 | SOYMON022 | g499164 | BLASTN | 122 | 1e-18 | 51 |
| 1788 | -700957441 | 700957441H1 | SOYMON022 | g2306989 | BLASTN | 53 | 1e-17 | 79 |
| 1789 | -700958607 | 700958607H1 | SOYMON022 | g2529702 | BLASTN | 479 | 1e-51 | 77 |
| 1790 | -700959655 | 700959655H1 | SOYMON022 | g533708 | BLASTN | 695 | 1e-49 | 81 |
| 1791 | -700959810 | 700959810H1 | SOYMON022 | g1173829 | BLASTN | 539 | 1e-36 | 68 |
| 1792 | -700962277 | 700962277H1 | SOYMON022 | g1814424 | BLASTN | 103 | 1e-21 | 46 |
| 1793 | -700962294 | 700962294H1 | SOYMON022 | g1122533 | BLASTN | 116 | 1e-17 | 95 |
| 1794 | -700964766 | 700964766H1 | SOYMON022 | g1045042 | BLASTN | 144 | 1e-23 | 71 |
| 1795 | -700966827 | 700966827H1 | SOYMON028 | g1946221 | BLASTN | 481 | 1e-31 | 84 |
| 1796 | -700966971 | 700966971H1 | SOYMON029 | g1946221 | BLASTN | 747 | 1e-53 | 77 |
| 1797 | -700967672 | 700967672H1 | SOYMON032 | g527630 | BLASTN | 596 | 1e-40 | 77 |
| 1798 | -700969205 | 700969205H1 | SOYMON005 | g527632 | BLASTN | 801 | 1e-57 | 79 |
| 1799 | -700974644 | 700974644H1 | SOYMON005 | g507219 | BLASTN | 583 | 1e-44 | 75 |
| 1800 | -700974946 | 700974946H1 | SOYMON005 | g666128 | BLASTN | 183 | 1e-26 | 62 |
| 1801 | -700986825 | 700986825H1 | SOYMON009 | g1946221 | BLASTN | 561 | 1e-37 | 75 |
| 1802 | -700989250 | 700989250H1 | SOYMON011 | g453948 | BLASTN | 509 | 1e-49 | 78 |
| 1803 | -700992777 | 700992777H1 | SOYMON011 | g1122533 | BLASTN | 214 | 1e-31 | 58 |
| 1804 | -700993450 | 700993450H1 | SOYMON011 | g767700 | BLASTN | 585 | 1e-39 | 68 |
| 1805 | -700995393 | 700995393H1 | SOYMON011 | g1167915 | BLASTN | 488 | 1e-30 | 78 |
| 1806 | -700996901 | 700996901H1 | SOYMON018 | g2464893 | BLASTN | 122 | 1e-18 | 75 |
| 1807 | -701007678 | 701007678H1 | SOYMON019 | g166756 | BLASTN | 115 | 1e-19 | 100 |
| 1808 | -701009713 | 701009713H1 | SOYMON019 | g2501810 | BLASTN | 117 | 1e-21 | 41 |
| 1809 | -701009968 | 701009968H2 | SOYMON019 | g1435023 | BLASTN | 165 | 1e-25 | 78 |
| 1810 | -701012033 | 701012033H1 | SOYMON019 | g1234900 | BLASTN | 138 | 1e-21 | 88 |
| 1811 | -701013785 | 701013785H1 | SOYMON019 | g2464893 | BLASTN | 164 | 1e-24 | 93 |
| 1812 | -701014405 | 701014405H1 | SOYMON019 | g1045041 | BLASTN | 459 | 1e-29 | 68 |
| 1813 | -701037074 | 701037074H1 | SOYMON029 | g1122533 | BLASTN | 99 | 1e-18 | 71 |
| 1814 | -701038758 | 701038758H1 | SOYMON029 | g1946221 | BLASTN | 628 | 1e-43 | 82 |
| 1815 | -701042583 | 701042583H1 | SOYMON029 | g1946221 | BLASTN | 907 | 1e-66 | 86 |
| 1816 | -701044439 | 701044439H1 | SOYMON032 | g1814424 | BLASTN | 198 | 1e-29 | 51 |
| 1817 | -701044558 | 701044558H1 | SOYMON032 | g1173622 | BLASTN | 159 | 1e-24 | 87 |
| 1818 | -701050612 | 701050612H1 | SOYMON032 | g527632 | BLASTN | 599 | 1e-41 | 77 |
| 1819 | -701119065 | 701119065H1 | SOYMON037 | g1946221 | BLASTN | 451 | 1e-28 | 81 |
| 1820 | -701128657 | 701128657H1 | SOYMON037 | g310568 | BLASTN | 593 | 1e-48 | 90 |
| 1821 | -701133994 | 701133994H2 | SOYMON038 | g453949 | BLASTN | 247 | 1e-36 | 60 |
| 1822 | -701134378 | 701134378H1 | SOYMON038 | g1435023 | BLASTN | 128 | 1e-19 | 87 |
| 1823 | -701136723 | 701136723H1 | SOYMON038 | g19486 | BLASTN | 180 | 1e-27 | 57 |
| 1824 | -701137384 | 701137384H1 | SOYMON038 | g606952 | BLASTN | 169 | 1e-25 | 57 |
| 1825 | -701141686 | 701141686H1 | SOYMON038 | g349378 | BLASTN | 316 | 1e-36 | 74 |
| 1826 | -701145388 | 701145388H1 | SOYMON031 | g453949 | BLASTN | 111 | 1e-19 | 67 |
| 1827 | -701146987 | 701146987H1 | SOYMON031 | g549887 | BLASTN | 177 | 1e-30 | 71 |
| 1828 | -701147041 | 701147041H1 | SOYMON031 | g1814424 | BLASTN | 257 | 1e-37 | 63 |
| 1829 | -701205621 | 701205621H1 | SOYMON035 | g349378 | BLASTN | 500 | 1e-32 | 75 |
| 1830 | -701206538 | 701206538H1 | SOYMON035 | g1234899 | BLASTN | 465 | 1e-29 | 76 |
| 1831 | -701211327 | 701211327H1 | SOYMON035 | g533708 | BLASTN | 920 | 1e-67 | 84 |
| 1832 | -701211696 | 701211696H1 | SOYMON035 | g396198 | BLASTN | 227 | 1e-17 | 75 |
| 1833 | -701211947 | 701211947H1 | SOYMON035 | g1173621 | BLASTN | 446 | 1e-27 | 81 |
| 1834 | -701215129 | 701215129H1 | SOYMON035 | g453948 | BLASTN | 437 | 1e-45 | 80 |
| 1835 | 10171 | 700953820H1 | SOYMON022 | g313113 | BLASTN | 179 | 1e-26 | 85 |
| 1836 | 1047 | 700787538H1 | SOYMON011 | g1122533 | BLASTN | 174 | 1e-25 | 40 |

-continued

SOYBEAN HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1837 | 1047 | 700834648H1 | SOYMON019 | g1122533 | BLASTN | 190 | 1e-28 | 50 |
| 1838 | 1047 | 700834669H1 | SOYMON019 | g1122533 | BLASTN | 217 | 1e-31 | 47 |
| 1839 | 1047 | 700864996H1 | SOYMON016 | g1122533 | BLASTN | 213 | 1e-31 | 45 |
| 1840 | 10628 | 700835067H1 | SOYMON019 | g1435023 | BLASTN | 200 | 1e-31 | 82 |
| 1841 | 10628 | 700953324H1 | SOYMON022 | g1435023 | BLASTN | 130 | 1e-20 | 75 |
| 1842 | 10628 | LIB3051-044-Q1-K1-G5 | LIB3051 | g767700 | BLASTN | 649 | 1e-43 | 77 |
| 1843 | 10951 | 700663182H1 | SOYMON005 | g767700 | BLASTN | 391 | 1e-40 | 76 |
| 1844 | 10951 | 700797519H1 | SOYMON017 | g767700 | BLASTN | 637 | 1e-44 | 76 |
| 1845 | 10951 | 700849171H1 | SOYMON021 | g767700 | BLASTN | 541 | 1e-36 | 75 |
| 1846 | 10951 | 700865713H1 | SOYMON016 | g499162 | BLASTN | 83 | 1e-17 | 58 |
| 1847 | 10951 | 700901065H1 | SOYMON027 | g767700 | BLASTN | 606 | 1e-41 | 75 |
| 1848 | 10951 | 700907319H1 | SOYMON022 | g767700 | BLASTN | 521 | 1e-43 | 74 |
| 1849 | 10951 | 700956307H1 | SOYMON022 | g767700 | BLASTN | 687 | 1e-48 | 76 |
| 1850 | 10951 | 701100975H1 | SOYMON028 | g1435023 | BLASTN | 158 | 1e-24 | 55 |
| 1851 | 10951 | 701119381H1 | SOYMON037 | g767700 | BLASTN | 646 | 1e-45 | 75 |
| 1852 | 10951 | 701127370H1 | SOYMON037 | g767700 | BLASTN | 764 | 1e-54 | 76 |
| 1853 | 10951 | 701146808H1 | SOYMON031 | g767700 | BLASTN | 398 | 1e-41 | 78 |
| 1854 | 10951 | LIB3030-008-Q1-B1-G4 | LIB3030 | g767700 | BLASTN | 397 | 1e-34 | 73 |
| 1855 | 11866 | 700891680H1 | SOYMON024 | g2529703 | BLASTN | 140 | 1e-25 | 62 |
| 1856 | 12278 | 701066638H1 | SOYMON034 | g16327 | BLASTN | 194 | 1e-10 | 80 |
| 1857 | 12636 | 700662285H1 | SOYMON005 | g1234899 | BLASTN | 229 | 1e-17 | 81 |
| 1858 | 12636 | 701038730H1 | SOYMON029 | g1234899 | BLASTN | 184 | 1e-13 | 84 |
| 1859 | 13299 | 700843946H1 | SOYMON021 | g1435021 | BLASTN | 202 | 1e-29 | 57 |
| 1860 | 13299 | 700984301H1 | SOYMON009 | g1435021 | BLASTN | 95 | 1e-17 | 60 |
| 1861 | 13299 | 701121896H1 | SOYMON037 | g1435021 | BLASTN | 176 | 1e-25 | 58 |
| 1862 | 13299 | LIB3040-007-Q1-E1-A1 | LIB3040 | g1435021 | BLASTN | 133 | 1e-36 | 46 |
| 1863 | 13344 | 700830015H1 | SOYMON019 | g349378 | BLASTN | 406 | 1e-35 | 84 |
| 1864 | 13344 | 701070177H1 | SOYMON034 | g349378 | BLASTN | 780 | 1e-61 | 82 |
| 1865 | 13595 | 700872792H1 | SOYMON018 | g1122533 | BLASTN | 197 | 1e-29 | 78 |
| 1866 | 1426 | 700952294H1 | SOYMON022 | g19357 | BLASTN | 390 | 1e-41 | 82 |
| 1867 | 15006 | 701109138H1 | SOYMON036 | g313113 | BLASTN | 192 | 1e-28 | 62 |
| 1868 | 15688 | 700943842H1 | SOYMON024 | g527628 | BLASTN | 788 | 1e-56 | 77 |
| 1869 | 15688 | 700979909H1 | SOYMON009 | g1165131 | BLASTN | 338 | 1e-21 | 72 |
| 1870 | 16 | 700968161H1 | SOYMON035 | g16155 | BLASTN | 356 | 1e-35 | 78 |
| 1871 | 16 | 701145163H1 | SOYMON031 | g313112 | BLASTN | 529 | 1e-35 | 79 |
| 1872 | 16 | 701208220H1 | SOYMON035 | g396198 | BLASTN | 589 | 1e-53 | 79 |
| 1873 | 16 | 701212468H1 | SOYMON035 | g396198 | BLASTN | 545 | 1e-49 | 79 |
| 1874 | 16 | 701215351H1 | SOYMON035 | g848998 | BLASTN | 865 | 1e-63 | 79 |
| 1875 | 16 | LIB3049-006-Q1-E1-D4 | LIB3049 | g848998 | BLASTN | 1098 | 1e-82 | 79 |
| 1876 | 16 | LIB3049-050-Q1-E1-B12 | LIB3049 | g396198 | BLASTN | 477 | 1e-53 | 79 |
| 1877 | 1658 | 700556120H1 | SOYMON001 | g1161574 | BLASTN | 259 | 1e-10 | 77 |
| 1878 | 1658 | 700559250H1 | SOYMON001 | g767697 | BLASTN | 268 | 1e-11 | 79 |
| 1879 | 1658 | 700565790H1 | SOYMON002 | g767697 | BLASTN | 247 | 1e-10 | 76 |
| 1880 | 1658 | 700653746H1 | SOYMON003 | g349262 | BLASTN | 447 | 1e-28 | 71 |
| 1881 | 1658 | 700673109H1 | SOYMON006 | g767697 | BLASTN | 261 | 1e-10 | 77 |
| 1882 | 1658 | 700685043H1 | SOYMON008 | g767697 | BLASTN | 259 | 1e-10 | 77 |
| 1883 | 1658 | 700686169H1 | SOYMON008 | g767697 | BLASTN | 268 | 1e-11 | 79 |
| 1884 | 1658 | 700741361H1 | SOYMON012 | g767697 | BLASTN | 268 | 1e-11 | 79 |
| 1885 | 1658 | 700749356H1 | SOYMON013 | g767697 | BLASTN | 268 | 1e-11 | 79 |
| 1886 | 1658 | 700797949H1 | SOYMON017 | g767697 | BLASTN | 261 | 1e-10 | 77 |
| 1887 | 1658 | 700833223H1 | SOYMON019 | g767697 | BLASTN | 268 | 1e-11 | 79 |
| 1888 | 1658 | 700834106H1 | SOYMON019 | g767697 | BLASTN | 268 | 1e-11 | 79 |
| 1889 | 1658 | 700845743H1 | SOYMON021 | g767697 | BLASTN | 261 | 1e-10 | 77 |
| 1890 | 1658 | 700848684H1 | SOYMON021 | g767697 | BLASTN | 254 | 1e-10 | 76 |
| 1891 | 1658 | 700874876H1 | SOYMON018 | g349263 | BLASTN | 102 | 1e-17 | 64 |
| 1892 | 1658 | 700906912H1 | SOYMON022 | g767697 | BLASTN | 261 | 1e-10 | 77 |
| 1893 | 1658 | 700952665H1 | SOYMON022 | g767697 | BLASTN | 261 | 1e-10 | 77 |
| 1894 | 1658 | 700974873H1 | SOYMON005 | g767697 | BLASTN | 268 | 1e-11 | 79 |
| 1895 | 1658 | 700997270H1 | SOYMON018 | g767697 | BLASTN | 268 | 1e-11 | 79 |
| 1896 | 1658 | 701012341H1 | SOYMON019 | g767697 | BLASTN | 261 | 1e-12 | 79 |
| 1897 | 1658 | 701015394H1 | SOYMON019 | g1161574 | BLASTN | 242 | 1e-09 | 83 |
| 1898 | 1658 | 701041243H1 | SOYMON029 | g767697 | BLASTN | 268 | 1e-11 | 79 |
| 1899 | 1658 | 701042768H1 | SOYMON029 | g767697 | BLASTN | 268 | 1e-11 | 79 |
| 1900 | 1658 | 701059909H1 | SOYMON033 | g1161574 | BLASTN | 623 | 1e-43 | 71 |
| 1901 | 1658 | 701063152H1 | SOYMON033 | g767697 | BLASTN | 268 | 1e-11 | 79 |
| 1902 | 1658 | 701102929H1 | SOYMON028 | g767697 | BLASTN | 240 | 1e-09 | 74 |
| 1903 | 1658 | 701106204H1 | SOYMON036 | g767697 | BLASTN | 261 | 1e-10 | 77 |
| 1904 | 1658 | 701124334H1 | SOYMON037 | g349262 | BLASTN | 406 | 1e-25 | 70 |
| 1905 | 1658 | 701149165H1 | SOYMON031 | g767697 | BLASTN | 259 | 1e-10 | 77 |

-continued

SOYBEAN HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1906 | 1658 | LIB3055-007-Q1-N1-C5 | LIB3055 | g767697 | BLASTN | 268 | 1e-11 | 79 |
| 1907 | 1658 | LIB3040-041-Q1-E1-A7 | LIB3040 | g767697 | BLASTN | 250 | 1e-09 | 78 |
| 1908 | 1718 | LIB3050-004-Q1-E1-E10 | LIB3050 | g2914706 | BLASTN | 175 | 1e-49 | 87 |
| 1909 | 17759 | 700944041H1 | SOYMON024 | g1435021 | BLASTN | 186 | 1e-27 | 65 |
| 1910 | 17759 | 700962082H1 | SOYMON022 | g1435021 | BLASTN | 176 | 1e-25 | 62 |
| 1911 | 17759 | 700989672H1 | SOYMON011 | g767697 | BLASTN | 516 | 1e-34 | 66 |
| 1912 | 17759 | 701132610H1 | SOYMON038 | g767695 | BLASTN | 362 | 1e-34 | 71 |
| 1913 | 17759 | LIB3056-005-Q1-N1-G1 | LIB3056 | g166753 | BLASTN | 492 | 1e-30 | 68 |
| 1914 | 18347 | 700646488H1 | SOYMON013 | g1122533 | BLASTN | 223 | 1e-40 | 59 |
| 1915 | 18484 | 700731466H1 | SOYMON010 | g549887 | BLASTN | 121 | 1e-25 | 83 |
| 1916 | 18636 | 700868354H1 | SOYMON016 | g453948 | BLASTN | 462 | 1e-29 | 75 |
| 1917 | 18636 | 700868363H1 | SOYMON016 | g1045042 | BLASTN | 162 | 1e-24 | 83 |
| 1918 | 18636 | 700959894H1 | SOYMON022 | g453948 | BLASTN | 523 | 1e-34 | 79 |
| 1919 | 18636 | LIB3040-005-Q1-E1-B5 | LIB3040 | g453948 | BLASTN | 355 | 1e-18 | 77 |
| 1920 | 18636 | LIB3040-006-Q1-E1-B12 | LIB3040 | g453948 | BLASTN | 523 | 1e-79 | 77 |
| 1921 | 18636 | LIB3039-044-Q1-E1-D1 | LIB3039 | g453948 | BLASTN | 523 | 1e-57 | 78 |
| 1922 | 19378 | 700681050H1 | SOYMON008 | g1122533 | BLASTN | 194 | 1e-37 | 63 |
| 1923 | 19378 | 700865851H1 | SOYMON016 | g1122532 | BLASTN | 529 | 1e-35 | 70 |
| 1924 | 20880 | 700684286H1 | SOYMON008 | g2464893 | BLASTN | 142 | 1e-21 | 54 |
| 1925 | 20880 | 700953247H1 | SOYMON022 | g2464893 | BLASTN | 124 | 1e-18 | 49 |
| 1926 | 21539 | 700990486H1 | SOYMON011 | g533708 | BLASTN | 462 | 1e-28 | 75 |
| 1927 | 21600 | 700958592H1 | SOYMON022 | g1814424 | BLASTN | 298 | 1e-42 | 74 |
| 1928 | 21600 | 700958595H1 | SOYMON022 | g1814424 | BLASTN | 311 | 1e-44 | 76 |
| 1929 | 21665 | 700757588H1 | SOYMON015 | g396199 | BLASTN | 109 | 1e-20 | 74 |
| 1930 | 22239 | 701204823H1 | SOYMON035 | g396198 | BLASTN | 859 | 1e-62 | 77 |
| 1931 | 22239 | 701207895H1 | SOYMON035 | g396198 | BLASTN | 568 | 1e-46 | 81 |
| 1932 | 2236 | 700559386H1 | SOYMON001 | g1234899 | BLASTN | 1400 | 1e-108 | 98 |
| 1933 | 2236 | 700684212H1 | SOYMON008 | g1234899 | BLASTN | 230 | 1e-13 | 92 |
| 1934 | 2236 | 700684793H1 | SOYMON008 | g1234899 | BLASTN | 383 | 1e-73 | 98 |
| 1935 | 2236 | 700684939H1 | SOYMON008 | g1234899 | BLASTN | 784 | 1e-90 | 91 |
| 1936 | 2236 | 700897221H1 | SOYMON027 | g1234899 | BLASTN | 1104 | 1e-83 | 95 |
| 1937 | 2236 | 700909715H1 | SOYMON022 | g1234899 | BLASTN | 586 | 1e-89 | 100 |
| 1938 | 2236 | 701064059H1 | SOYMON034 | g1234899 | BLASTN | 1241 | 1e-94 | 98 |
| 1939 | 22386 | 700559832H1 | SOYMON001 | g349378 | BLASTN | 236 | 1e-08 | 61 |
| 1940 | 22386 | 700730196H1 | SOYMON009 | g349378 | BLASTN | 231 | 1e-12 | 74 |
| 1941 | 22386 | 701009892H1 | SOYMON019 | g349378 | BLASTN | 231 | 1e-09 | 71 |
| 1942 | 22840 | 700605162H2 | SOYMON003 | g16327 | BLASTN | 489 | 1e-30 | 78 |
| 1943 | 22840 | 701152996H1 | SOYMON031 | g16327 | BLASTN | 614 | 1e-42 | 73 |
| 1944 | 23172 | 700897094H1 | SOYMON027 | g1814423 | BLASTN | 604 | 1e-41 | 70 |
| 1945 | 23172 | 701202488H1 | SOYMON035 | g1814423 | BLASTN | 346 | 1e-35 | 75 |
| 1946 | 23688 | 700676705H1 | SOYMON007 | g2464906 | BLASTN | 203 | 1e-40 | 78 |
| 1947 | 23962 | 700903463H1 | SOYMON022 | g16023 | BLASTN | 594 | 1e-40 | 80 |
| 1948 | 23962 | 701153884H1 | SOYMON031 | g16023 | BLASTN | 588 | 1e-40 | 82 |
| 1949 | 25170 | 701041521H1 | SOYMON029 | g1122533 | BLASTN | 171 | 1e-25 | 72 |
| 1950 | 25474 | 701012028H1 | SOYMON019 | g1234899 | BLASTN | 618 | 1e-52 | 83 |
| 1951 | 25474 | 701012112H1 | SOYMON019 | g1234899 | BLASTN | 380 | 1e-31 | 71 |
| 1952 | 25474 | LIB3051-100-Q1-K1-D12 | LIB3051 | g1234900 | BLASTN | 157 | 1e-43 | 81 |
| 1953 | 2561 | 700762637H1 | SOYMON015 | g1234899 | BLASTN | 263 | 1e-12 | 82 |
| 1954 | 2561 | 700967837H1 | SOYMON033 | g1234899 | BLASTN | 265 | 1e-14 | 80 |
| 1955 | 26795 | 701212551H1 | SOYMON035 | g1045044 | BLASTN | 163 | 1e-24 | 78 |
| 1956 | 27638 | 701052052H1 | SOYMON032 | g2529701 | BLASTN | 171 | 1e-31 | 66 |
| 1957 | 27638 | 701054452H1 | SOYMON032 | g310568 | BLASTN | 502 | 1e-33 | 81 |
| 1958 | 29282 | 701053129H1 | SOYMON032 | g349381 | BLASTN | 147 | 1e-24 | 64 |
| 1959 | 29318 | 701064091H1 | SOYMON034 | g1234899 | BLASTN | 212 | 1e-16 | 84 |
| 1960 | 30433 | 701131088H1 | SOYMON038 | g767695 | BLASTN | 406 | 1e-23 | 75 |
| 1961 | 30433 | LIB3051-016-Q1-E1-G10 | LIB3051 | g767695 | BLASTN | 614 | 1e-40 | 71 |
| 1962 | 30817 | 700560926H1 | SOYMON001 | g1814423 | BLASTN | 416 | 1e-51 | 77 |
| 1963 | 30817 | 700756294H1 | SOYMON014 | g1814423 | BLASTN | 506 | 1e-33 | 73 |
| 1964 | 30817 | LIB3051-115-Q1-K1-G7 | LIB3051 | g1814424 | BLASTN | 241 | 1e-87 | 79 |
| 1965 | 30817 | LIB3051-115-Q1-K1-G8 | LIB3051 | g1814423 | BLASTN | 486 | 1e-29 | 70 |
| 1966 | 31478 | 700755133H1 | SOYMON014 | g1173829 | BLASTN | 589 | 1e-40 | 78 |
| 1967 | 31478 | LIB3051-048-Q1-K1-G8 | LIB3051 | g1173829 | BLASTN | 1200 | 1e-91 | 75 |
| 1968 | 32951 | 700974967H1 | SOYMON005 | g19486 | BLASTN | 138 | 1e-21 | 55 |

SOYBEAN HOMEOBOX TRANSCRIPTION FACTORS

| Seq No. | Cluster ID | CloneID | Library | NCBI gi | METHOD | Score | P-Value | % Ident |
|---|---|---|---|---|---|---|---|---|
| 1969 | 32951 | LIB3051-108-Q1-K1-H9 | LIB3051 | g19486 | BLASTN | 149 | 1e−38 | 55 |
| 1970 | 33012 | LIB3040-002-Q1-E1-A3 | LIB3040 | g1814234 | BLASTN | 110 | 1e−36 | 59 |
| 1971 | 3353 | 700559837H1 | SOYMON001 | g767700 | BLASTN | 632 | 1e−43 | 74 |
| 1972 | 3353 | 700646560H1 | SOYMON014 | g767700 | BLASTN | 413 | 1e−54 | 77 |
| 1973 | 3353 | 700739015H1 | SOYMON012 | g1435023 | BLASTN | 189 | 1e−51 | 79 |
| 1974 | 3353 | 700763993H1 | SOYMON019 | g767700 | BLASTN | 648 | 1e−45 | 80 |
| 1975 | 3353 | 700832983H1 | SOYMON019 | g767700 | BLASTN | 637 | 1e−44 | 70 |
| 1976 | 3353 | 700863990H1 | SOYMON016 | g1435023 | BLASTN | 253 | 1e−38 | 65 |
| 1977 | 3353 | 700873703H1 | SOYMON018 | g767700 | BLASTN | 799 | 1e−57 | 77 |
| 1978 | 3353 | 700944678H1 | SOYMON024 | g767700 | BLASTN | 760 | 1e−54 | 78 |
| 1979 | 3353 | 701014184H1 | SOYMON019 | g767700 | BLASTN | 614 | 1e−56 | 76 |
| 1980 | 3353 | 701133677H2 | SOYMON038 | g767700 | BLASTN | 486 | 1e−51 | 74 |
| 1981 | 3353 | 701136948H1 | SOYMON038 | g767700 | BLASTN | 465 | 1e−28 | 75 |
| 1982 | 3353 | LIB3030-007-Q1-B1-A2 | LIB3030 | g767700 | BLASTN | 1081 | 1e−81 | 75 |
| 1983 | 3353 | LIB3051-002-Q1-E1-F10 | LIB3051 | g767700 | BLASTN | 874 | 1e−64 | 76 |
| 1984 | 3353 | LIB3051-015-Q1-E1-E9 | LIB3051 | g767700 | BLASTN | 953 | 1e−70 | 75 |
| 1985 | 5429 | LIB3051-108-Q1-K1-A3 | LIB3051 | g2914706 | BLASTN | 129 | 1e−43 | 56 |
| 1986 | 5724 | 700672222H1 | SOYMON006 | g499163 | BLASTN | 269 | 1e−11 | 72 |
| 1987 | 5724 | 700877190H1 | SOYMON018 | g499163 | BLASTN | 280 | 1e−12 | 71 |
| 1988 | 5724 | 700954530H1 | SOYMON022 | g499164 | BLASTN | 235 | 1e−34 | 64 |
| 1989 | 5724 | 701147769H1 | SOYMON031 | g499164 | BLASTN | 78 | 1e−24 | 58 |
| 1990 | 5724 | LIB3030-002-Q1-B1-A10 | LIB3030 | g3153207 | BLASTN | 153 | 1e−45 | 57 |
| 1991 | 5936 | 700606207H1 | SOYMON008 | g349266 | BLASTN | 452 | 1e−29 | 80 |
| 1992 | 7300 | 700671024H1 | SOYMON006 | g1435023 | BLASTN | 149 | 1e−22 | 71 |
| 1993 | 7300 | 700788665H1 | SOYMON011 | g1435023 | BLASTN | 212 | 1e−32 | 75 |
| 1994 | 7484 | LIB3065-014-Q1-N1-F3 | LIB3065 | g499162 | BLASTN | 93 | 1e−38 | 62 |
| 1995 | 7661 | 700728721H1 | SOYMON009 | g767697 | BLASTN | 637 | 1e−44 | 75 |
| 1996 | 7661 | 700871987H1 | SOYMON018 | g767695 | BLASTN | 579 | 1e−39 | 76 |
| 1997 | 7661 | 700874351H1 | SOYMON018 | g767695 | BLASTN | 555 | 1e−37 | 74 |
| 1998 | 7661 | 700876296H1 | SOYMON018 | g1435021 | BLASTN | 190 | 1e−36 | 75 |
| 1999 | 8490 | 701036975H1 | SOYMON029 | g2464893 | BLASTN | 197 | 1e−28 | 69 |
| 2000 | 9415 | 700865525H1 | SOYMON016 | g1122532 | BLASTN | 501 | 1e−32 | 70 |

SOYBEAN HLH TRANSCRIPTION FACTORS

| Seq No. | Cluster ID | CloneID | Library | NCBI gi | METHOD | Score | P-Value | % Ident |
|---|---|---|---|---|---|---|---|---|
| 2001 | -700555065 | 700555065H1 | SOYMON001 | g1142618 | BLASTN | 434 | 1e−70 | 84 |
| 2002 | -700559493 | 700559493H1 | SOYMON001 | g53018 | BLASTN | 131 | 1e−38 | 74 |
| 2003 | -700667019 | 700667019H1 | SOYMON005 | g1142618 | BLASTN | 777 | 1e−55 | 83 |
| 2004 | -700685842 | 700685842H1 | SOYMON008 | g2351072 | BLASTN | 453 | 1e−27 | 74 |
| 2005 | -700727678 | 700727678H1 | SOYMON009 | g1142619 | BLASTN | 115 | 1e−17 | 79 |
| 2006 | -700789561 | 700789561H2 | SOYMON011 | g2351072 | BLASTN | 231 | 1e−20 | 69 |
| 2007 | -700876112 | 700876112H1 | SOYMON018 | g1154626 | BLASTN | 328 | 1e−30 | 80 |
| 2008 | -700898156 | 700898156H1 | SOYMON027 | g1142618 | BLASTN | 370 | 1e−40 | 78 |
| 2009 | -700909057 | 700909057H1 | SOYMON022 | g1142618 | BLASTN | 461 | 1e−29 | 88 |
| 2010 | -700953178 | 700953178H1 | SOYMON022 | g1142619 | BLASTN | 85 | 1e−20 | 89 |
| 2011 | -700963882 | 700963882H1 | SOYMON022 | g2351072 | BLASTN | 621 | 1e−43 | 73 |
| 2012 | -700969727 | 700969727H1 | SOYMON005 | g2351072 | BLASTN | 192 | 1e−09 | 73 |
| 2013 | -700981519 | 700981519H1 | SOYMON009 | g1142619 | BLASTN | 220 | 1e−32 | 86 |
| 2014 | -700982772 | 700982772H1 | SOYMON009 | g1142618 | BLASTN | 536 | 1e−49 | 81 |
| 2015 | -700992250 | 700992250H1 | SOYMON011 | g1142618 | BLASTN | 529 | 1e−35 | 73 |
| 2016 | -700995549 | 700995549H1 | SOYMON011 | g1154626 | BLASTN | 378 | 1e−39 | 74 |
| 2017 | -701061047 | 701061047H1 | SOYMON033 | g527663 | BLASTN | 67 | 1e−18 | 49 |
| 2018 | -701065109 | 701065109H1 | SOYMON034 | g527663 | BLASTN | 67 | 1e−17 | 52 |
| 2019 | -701098613 | 701098613H1 | SOYMON028 | g2351072 | BLASTN | 409 | 1e−23 | 67 |
| 2020 | -701099791 | 701099791H1 | SOYMON028 | g1142618 | BLASTN | 535 | 1e−35 | 73 |
| 2021 | -701104269 | 701104269H1 | SOYMON036 | g2351072 | BLASTN | 270 | 1e−11 | 81 |
| 2022 | -701105510 | 701105510H1 | SOYMON036 | g1154626 | BLASTN | 142 | 1e−26 | 79 |
| 2023 | -701108367 | 701108367H1 | SOYMON036 | g1142618 | BLASTN | 934 | 1e−68 | 84 |
| 2024 | -701148492 | 701148492H1 | SOYMON031 | g2351072 | BLASTN | 574 | 1e−38 | 75 |
| 2025 | -701154036 | 701154036H1 | SOYMON031 | g2351072 | BLASTN | 588 | 1e−41 | 86 |

-continued

SOYBEAN HLH TRANSCRIPTION FACTORS

| Seq No. | Cluster ID | CloneID | Library | NCBI gi | METHOD | Score | P-Value | % Ident |
|---|---|---|---|---|---|---|---|---|
| 2026 | 10449 | 700872082H1 | SOYMON018 | g1154626 | BLASTN | 395 | 1e-34 | 77 |
| 2027 | 11917 | 700749314H1 | SOYMON013 | g527653 | BLASTN | 68 | 1e-18 | 45 |
| 2028 | 16 | 700658882H1 | SOYMON004 | g343349 | BLASTN | 580 | 1e-39 | 100 |
| 2029 | 16 | 700789347H2 | SOYMON011 | g343349 | BLASTN | 620 | 1e-43 | 100 |
| 2030 | 16 | 700970836H1 | SOYMON005 | g343349 | BLASTN | 559 | 1e-37 | 97 |
| 2031 | 16 | 700972287H1 | SOYMON005 | g343349 | BLASTN | 405 | 1e-46 | 98 |
| 2032 | 16 | LIB3049-025-Q1-E1-H12 | LIB3049 | g343349 | BLASTN | 624 | 1e-43 | 98 |
| 2033 | 16 | LIB3040-018-Q1-E1-D9 | LIB3040 | g343349 | BLASTN | 690 | 1e-48 | 97 |
| 2034 | 16 | LIB3040-044-Q1-E1-F7 | LIB3040 | g343349 | BLASTN | 522 | 1e-34 | 98 |
| 2035 | 16 | LIB3040-049-Q1-E1-G6 | LIB3040 | g343349 | BLASTN | 678 | 1e-47 | 97 |
| 2036 | 16 | LIB3049-002-Q1-E1-E2 | LIB3049 | g343349 | BLASTN | 344 | 1e-18 | 79 |
| 2037 | 16785 | 700653875H1 | SOYMON003 | g1154626 | BLASTN | 611 | 1e-41 | 77 |
| 2038 | 18672 | 700899094H1 | SOYMON027 | g1142619 | BLASTN | 170 | 1e-24 | 58 |
| 2039 | 18672 | 700899263H1 | SOYMON027 | g1142619 | BLASTN | 144 | 1e-21 | 66 |
| 2040 | 19346 | 700761358H1 | SOYMON015 | g1465368 | BLASTN | 249 | 1e-36 | 88 |
| 2041 | 20124 | 700869958H1 | SOYMON016 | g1142619 | BLASTN | 139 | 1e-21 | 89 |
| 2042 | 20124 | 701107971H1 | SOYMON036 | g1142618 | BLASTN | 431 | 1e-27 | 81 |
| 2043 | 20916 | 701102444H1 | SOYMON028 | g2351072 | BLASTN | 290 | 1e-12 | 72 |
| 2044 | 2148 | 700553590H1 | SOYMON001 | g1465367 | BLASTN | 216 | 1e-31 | 74 |
| 2045 | 2148 | 700553889H1 | SOYMON001 | g1465367 | BLASTN | 225 | 1e-17 | 70 |
| 2046 | 2148 | 700660115H1 | SOYMON004 | g1465367 | BLASTN | 182 | 1e-22 | 75 |
| 2047 | 2148 | 700746715H1 | SOYMON013 | g1465367 | BLASTN | 198 | 1e-19 | 73 |
| 2048 | 2148 | 700752031H1 | SOYMON014 | g1465367 | BLASTN | 200 | 1e-26 | 71 |
| 2049 | 2148 | 700835783H1 | SOYMON019 | g1465367 | BLASTN | 168 | 1e-14 | 76 |
| 2050 | 25927 | 701015416H1 | SOYMON019 | g1465367 | BLASTN | 205 | 1e-29 | 77 |
| 2051 | 25927 | 701066344H1 | SOYMON034 | g1465367 | BLASTN | 246 | 1e-09 | 64 |
| 2052 | 25927 | 701150978H1 | SOYMON031 | g1465367 | BLASTN | 196 | 1e-19 | 75 |
| 2053 | 3134 | 700560257H1 | SOYMON001 | g2351072 | BLASTN | 306 | 1e-44 | 78 |
| 2054 | 3134 | 700698382H1 | SOYMON017 | g2351072 | BLASTN | 345 | 1e-35 | 77 |
| 2055 | 3134 | 700730295H1 | SOYMON009 | g2351072 | BLASTN | 281 | 1e-20 | 72 |
| 2056 | 3134 | 700747260H1 | SOYMON013 | g2351072 | BLASTN | 300 | 1e-44 | 76 |
| 2057 | 3134 | 700752110H1 | SOYMON014 | g2351072 | BLASTN | 345 | 1e-44 | 77 |
| 2058 | 3134 | 700756323H1 | SOYMON014 | g2351072 | BLASTN | 345 | 1e-44 | 77 |
| 2059 | 3134 | 700790347H2 | SOYMON011 | g2351072 | BLASTN | 254 | 1e-09 | 67 |
| 2060 | 3134 | 700896017H1 | SOYMON027 | g2351072 | BLASTN | 303 | 1e-40 | 77 |
| 2061 | 3134 | 700957024H1 | SOYMON022 | g2351072 | BLASTN | 300 | 1e-39 | 77 |
| 2062 | 3134 | 700964178H1 | SOYMON022 | g2351072 | BLASTN | 345 | 1e-41 | 79 |
| 2063 | 3134 | 700982832H1 | SOYMON009 | g2351072 | BLASTN | 345 | 1e-33 | 77 |
| 2064 | 3134 | 701051341H1 | SOYMON032 | g2351072 | BLASTN | 281 | 1e-40 | 77 |
| 2065 | 3134 | 701104855H1 | SOYMON036 | g2351072 | BLASTN | 292 | 1e-21 | 73 |
| 2066 | 3134 | 701124738H1 | SOYMON037 | g2351072 | BLASTN | 281 | 1e-21 | 73 |
| 2067 | 3134 | 701137532H1 | SOYMON038 | g2351072 | BLASTN | 324 | 1e-21 | 75 |
| 2068 | 3134 | 701215342H1 | SOYMON035 | g2351072 | BLASTN | 287 | 1e-21 | 73 |
| 2069 | 3134 | LIB3051-017-Q1-E1-C6 | LIB3051 | g2351072 | BLASTN | 340 | 1e-31 | 76 |
| 2070 | 3134 | LIB3051-010-Q1-E1-H3 | LIB3051 | g2351072 | BLASTN | 345 | 1e-40 | 77 |
| 2071 | 32315 | LIB3051-014-Q1-E1-A8 | LIB3051 | g2351072 | BLASTN | 385 | 1e-20 | 82 |
| 2072 | 32639 | LIB3051-023-Q1-K1-A8 | LIB3051 | g2351072 | BLASTN | 569 | 1e-35 | 72 |
| 2073 | 33704 | LIB3027-005-Q1-B1-E1 | LIB3027 | g3036810 | BLASTN | 176 | 1e-42 | 66 |
| 2074 | 33819 | 701065242H1 | SOYMON034 | g2351072 | BLASTN | 245 | 1e-09 | 64 |
| 2075 | 33819 | LIB3051-041-Q1-K1-D6 | LIB3051 | g2351072 | BLASTN | 311 | 1e-27 | 69 |
| 2076 | 5988 | 700557524H1 | SOYMON001 | g1142618 | BLASTN | 270 | 1e-12 | 81 |
| 2077 | 5988 | 700746259H1 | SOYMON013 | g1142619 | BLASTN | 116 | 1e-18 | 64 |
| 2078 | 5988 | 700749920H1 | SOYMON013 | g1142618 | BLASTN | 259 | 1e-27 | 75 |
| 2079 | 5988 | 700868390H1 | SOYMON016 | g1142619 | BLASTN | 113 | 1e-24 | 76 |
| 2080 | 5988 | 700900650H1 | SOYMON027 | g1142618 | BLASTN | 259 | 1e-23 | 70 |
| 2081 | 5988 | 700984856H1 | SOYMON009 | g1142618 | BLASTN | 243 | 1e-29 | 77 |
| 2082 | 5988 | 700991037H1 | SOYMON011 | g1142618 | BLASTN | 238 | 1e-10 | 74 |
| 2083 | 5988 | 701000541H1 | SOYMON018 | g1142618 | BLASTN | 259 | 1e-10 | 81 |
| 2084 | 5988 | 701130184H1 | SOYMON037 | g1142618 | BLASTN | 259 | 1e-11 | 81 |
| 2085 | 9168 | 701040904H1 | SOYMON029 | g2351072 | BLASTN | 279 | 1e-12 | 73 |

SOYBEAN LEUCINE ZIPPER TRANSCRIPTION FACTORS

| Seq No. | Cluster ID | CloneID | Library | NCBI gi | METHOD | Score | P-Value | % Ident |
|---|---|---|---|---|---|---|---|---|
| 2086 | -700561911 | 700561911H1 | SOYMON002 | g2244744 | BLASTN | 70 | 1e-24 | 52 |
| 2087 | -700645762 | 700645762H1 | SOYMON010 | g600854 | BLASTN | 420 | 1e-24 | 76 |
| 2088 | -700651877 | 700651877H1 | SOYMON003 | g2253278 | BLASTN | 150 | 1e-22 | 48 |
| 1752 | -700659382 | 700659382H1 | SOYMON004 | g1435021 | BLASTN | 102 | 1e-20 | 42 |
| 2089 | -700664867 | 700664867H1 | SOYMON005 | g1905785 | BLASTN | 136 | 1e-36 | 62 |
| 2090 | -700666259 | 700666259H1 | SOYMON005 | g19275 | BLASTN | 211 | 1e-31 | 45 |
| 2091 | -700668136 | 700668136H1 | SOYMON006 | g19275 | BLASTN | 128 | 1e-19 | 50 |
| 2092 | -700673243 | 700673243H1 | SOYMON006 | g179969 | BLASTN | 187 | 1e-27 | 50 |
| 2093 | -700683530 | 700683530H1 | SOYMON008 | g2244744 | BLASTN | 192 | 1e-30 | 46 |
| 2094 | -700726285 | 700726285H1 | SOYMON009 | g2317905 | BLASTN | 116 | 1e-20 | 70 |
| 2095 | -700729493 | 700729493H1 | SOYMON009 | g19274 | BLASTN | 583 | 1e-39 | 76 |
| 2096 | -700734757 | 700734757H1 | SOYMON010 | g600855 | BLASTN | 161 | 1e-23 | 36 |
| 2097 | -700748271 | 700748271H1 | SOYMON013 | g1354856 | BLASTN | 216 | 1e-10 | 85 |
| 2098 | -700749120 | 700749120H1 | SOYMON013 | g19275 | BLASTN | 119 | 1e-19 | 72 |
| 2099 | -700753224 | 700753224H1 | SOYMON014 | g2317905 | BLASTN | 146 | 1e-22 | 84 |
| 2100 | -700755845 | 700755845H1 | SOYMON014 | g19275 | BLASTN | 120 | 1e-18 | 69 |
| 2101 | -700758569 | 700758569H1 | SOYMON015 | g2246376 | BLASTN | 116 | 1e-17 | 39 |
| 2102 | -700790606 | 700790606H2 | SOYMON011 | g2244744 | BLASTN | 114 | 1e-18 | 60 |
| 2103 | -700791712 | 700791712H1 | SOYMON011 | g1052959 | BLASTN | 542 | 1e-47 | 86 |
| 2104 | -700793594 | 700793594H1 | SOYMON017 | g600854 | BLASTN | 784 | 1e-56 | 77 |
| 2105 | -700794075 | 700794075H1 | SOYMON017 | g600855 | BLASTN | 165 | 1e-24 | 73 |
| 2106 | -700795892 | 700795892H1 | SOYMON017 | g2264378 | BLASTN | 149 | 1e-22 | 61 |
| 1764 | -700829533 | 700829533H1 | SOYMON019 | g767699 | BLASTN | 634 | 1e-44 | 83 |
| 2107 | -700834555 | 700834555H1 | SOYMON019 | g600855 | BLASTN | 138 | 1e-21 | 34 |
| 2108 | -700834891 | 700834891H1 | SOYMON019 | g1769891 | BLASTN | 155 | 1e-23 | 55 |
| 2109 | -700836073 | 700836073H1 | SOYMON019 | g2244744 | BLASTN | 121 | 1e-19 | 59 |
| 2110 | -700836512 | 700836512H1 | SOYMON020 | g2253278 | BLASTN | 146 | 1e-22 | 85 |
| 2111 | -700846936 | 700846936H1 | SOYMON021 | g1905785 | BLASTN | 170 | 1e-25 | 47 |
| 2112 | -700847523 | 700847523H1 | SOYMON021 | g1769890 | BLASTN | 363 | 1e-19 | 77 |
| 2113 | -700848955 | 700848955H1 | SOYMON021 | g1806261 | BLASTN | 86 | 1e-18 | 63 |
| 2114 | -700851525 | 700851525H1 | SOYMON023 | g19275 | BLASTN | 169 | 1e-29 | 46 |
| 2115 | -700852828 | 700852828H1 | SOYMON023 | g2264378 | BLASTN | 117 | 1e-19 | 63 |
| 2116 | -700868689 | 700868689H1 | SOYMON016 | g2317905 | BLASTN | 130 | 1e-25 | 73 |
| 1771 | -700869580 | 700869580H1 | SOYMON016 | g767697 | BLASTN | 292 | 1e-21 | 66 |
| 2117 | -700874241 | 700874241H1 | SOYMON018 | g2317905 | BLASTN | 120 | 1e-18 | 53 |
| 2118 | -700888837 | 700888837H1 | SOYMON024 | g2104676 | BLASTN | 521 | 1e-34 | 78 |
| 2119 | -700890849 | 700890849H1 | SOYMON024 | g170284 | BLASTN | 244 | 1e-09 | 77 |
| 2120 | -700891135 | 700891135H1 | SOYMON024 | g2244741 | BLASTN | 359 | 1e-19 | 64 |
| 1774 | -700893192 | 700893192H1 | SOYMON024 | g767697 | BLASTN | 596 | 1e-40 | 76 |
| 2121 | -700905635 | 700905635H1 | SOYMON022 | g2253277 | BLASTN | 590 | 1e-40 | 72 |
| 2122 | -700909752 | 700909752H1 | SOYMON022 | g435944 | BLASTN | 112 | 1e-17 | 48 |
| 2123 | -700952976 | 700952976H1 | SOYMON022 | g1806261 | BLASTN | 79 | 1e-17 | 68 |
| 2124 | -700960533 | 700960533H1 | SOYMON022 | g1354856 | BLASTN | 652 | 1e-69 | 89 |
| 2125 | -700962359 | 700962359H1 | SOYMON022 | g19275 | BLASTN | 84 | 1e-20 | 36 |
| 2126 | -700970658 | 700970658H1 | SOYMON005 | g19275 | BLASTN | 193 | 1e-28 | 53 |
| 2127 | -700972495 | 700972495H1 | SOYMON005 | g179969 | BLASTN | 101 | 1e-18 | 46 |
| 2128 | -700974981 | 700974981H1 | SOYMON005 | g2264378 | BLASTN | 86 | 1e-26 | 64 |
| 2129 | -700981471 | 700981471H1 | SOYMON009 | g2104674 | BLASTN | 952 | 1e-70 | 84 |
| 2130 | -700985719 | 700985719H1 | SOYMON009 | g19275 | BLASTN | 157 | 1e-23 | 61 |
| 2131 | -700989168 | 700989168H1 | SOYMON011 | g2246375 | BLASTN | 484 | 1e-37 | 74 |
| 1804 | -700993450 | 700993450H1 | SOYMON011 | g767700 | BLASTN | 585 | 1e-39 | 68 |
| 2132 | -700995729 | 700995729H1 | SOYMON011 | g1354856 | BLASTN | 170 | 1e-09 | 86 |
| 2133 | -700999491 | 700999491H1 | SOYMON018 | g19275 | BLASTN | 119 | 1e-30 | 46 |
| 2134 | -701006225 | 701006225H2 | SOYMON019 | g2104674 | BLASTN | 466 | 1e-59 | 80 |
| 2135 | -701009436 | 701009436H1 | SOYMON019 | g1806261 | BLASTN | 82 | 1e-18 | 68 |
| 2136 | -701009486 | 701009486H1 | SOYMON019 | g1806261 | BLASTN | 82 | 1e-18 | 68 |
| 1809 | -701009968 | 701009968H2 | SOYMON019 | g1435023 | BLASTN | 165 | 1e-25 | 78 |
| 1810 | -701012033 | 701012033H1 | SOYMON019 | g1234900 | BLASTN | 138 | 1e-21 | 88 |
| 2137 | -701012878 | 701012878H1 | SOYMON019 | g19275 | BLASTN | 156 | 1e-25 | 43 |
| 2138 | -701042734 | 701042734H1 | SOYMON029 | g2281449 | BLASTN | 149 | 1e-24 | 81 |
| 2139 | -701051102 | 701051102H1 | SOYMON032 | g1806261 | BLASTN | 101 | 1e-22 | 50 |
| 2140 | -701051362 | 701051362H1 | SOYMON032 | g19274 | BLASTN | 595 | 1e-40 | 73 |
| 2141 | -701064780 | 701064780H1 | SOYMON034 | g19275 | BLASTN | 92 | 1e-24 | 40 |
| 2142 | -701099882 | 701099882H1 | SOYMON028 | g19275 | BLASTN | 112 | 1e-28 | 47 |
| 2143 | -701103732 | 701103732H1 | SOYMON036 | g21634 | BLASTN | 544 | 1e-36 | 80 |
| 2144 | -701120778 | 701120778H1 | SOYMON037 | g2104674 | BLASTN | 458 | 1e-43 | 80 |
| 2145 | -701126772 | 701126772H1 | SOYMON037 | g2104674 | BLASTN | 538 | 1e-42 | 79 |
| 2146 | -701128406 | 701128406H1 | SOYMON037 | g1806260 | BLASTN | 798 | 1e-57 | 78 |
| 1822 | -701134378 | 701134378H1 | SOYMON038 | g1435023 | BLASTN | 128 | 1e-19 | 87 |
| 2147 | -701142645 | 701142645H1 | SOYMON038 | g1354856 | BLASTN | 555 | 1e-52 | 86 |
| 2148 | -701147341 | 701147341H1 | SOYMON031 | g1806261 | BLASTN | 82 | 1e-18 | 68 |
| 2149 | -701149088 | 701149088H1 | SOYMON031 | g1122224 | BLASTN | 243 | 1e-09 | 81 |
| 1830 | -701206538 | 701206538H1 | SOYMON035 | g1234899 | BLASTN | 465 | 1e-29 | 76 |
| 2150 | -701208778 | 701208778H1 | SOYMON035 | g1769890 | BLASTN | 389 | 1e-22 | 76 |
| 2151 | -701210832 | 701210832H1 | SOYMON035 | g2246376 | BLASTN | 75 | 1e-17 | 48 |

-continued

SOYBEAN LEUCINE ZIPPER TRANSCRIPTION FACTORS

| Seq No. | Cluster ID | CloneID | Library | NCBI gi | METHOD | Score | P-Value | % Ident |
|---|---|---|---|---|---|---|---|---|
| 1840 | 10628 | 700835067H1 | SOYMON019 | g1435023 | BLASTN | 200 | 1e-31 | 82 |
| 1841 | 10628 | 700953324H1 | SOYMON022 | g1435023 | BLASTN | 130 | 1e-20 | 75 |
| 1842 | 10628 | LIB3051-044-Q1-K1-G5 | LIB3051 | g767700 | BLASTN | 649 | 1e-43 | 77 |
| 2152 | 10748 | 701139319H1 | SOYMON038 | g2317905 | BLASTN | 137 | 1e-28 | 87 |
| 1843 | 10951 | 700663182H1 | SOYMON005 | g767700 | BLASTN | 391 | 1e-40 | 76 |
| 1844 | 10951 | 700797519H1 | SOYMON017 | g767700 | BLASTN | 637 | 1e-44 | 76 |
| 1845 | 10951 | 700849171H1 | SOYMON021 | g767700 | BLASTN | 541 | 1e-36 | 75 |
| 1847 | 10951 | 700901065H1 | SOYMON027 | g767700 | BLASTN | 606 | 1e-41 | 75 |
| 1848 | 10951 | 700907319H1 | SOYMON022 | g767700 | BLASTN | 521 | 1e-43 | 74 |
| 1849 | 10951 | 700956307H1 | SOYMON022 | g767700 | BLASTN | 687 | 1e-48 | 76 |
| 1850 | 10951 | 701100975H1 | SOYMON028 | g1435023 | BLASTN | 158 | 1e-24 | 55 |
| 1851 | 10951 | 701119381H1 | SOYMON037 | g767700 | BLASTN | 646 | 1e-45 | 75 |
| 1852 | 10951 | 701127370H1 | SOYMON037 | g767700 | BLASTN | 764 | 1e-54 | 76 |
| 1853 | 10951 | 701146808H1 | SOYMON031 | g767700 | BLASTN | 398 | 1e-41 | 78 |
| 1854 | 10951 | LIB3030-008-Q1-B1-G4 | LIB3030 | g767700 | BLASTN | 397 | 1e-34 | 73 |
| 2153 | 11924 | 700562679H1 | SOYMON002 | g1806261 | BLASTN | 71 | 1e-17 | 74 |
| 2154 | 12495 | 700790262H2 | SOYMON011 | g19274 | BLASTN | 607 | 1e-41 | 73 |
| 2155 | 12495 | 700841043H1 | SOYMON020 | g19274 | BLASTN | 601 | 1e-41 | 74 |
| 2156 | 12495 | 701047778H1 | SOYMON032 | g19274 | BLASTN | 555 | 1e-37 | 67 |
| 2157 | 12495 | 701106992H1 | SOYMON036 | g19274 | BLASTN | 634 | 1e-43 | 74 |
| 2158 | 12495 | LIB3051-071-Q1-K1-D6 | LIB3051 | g19274 | BLASTN | 848 | 1e-60 | 69 |
| 1857 | 12636 | 700662285H1 | SOYMON005 | g1234899 | BLASTN | 229 | 1e-17 | 81 |
| 1858 | 12636 | 701038730H1 | SOYMON029 | g1234899 | BLASTN | 184 | 1e-13 | 84 |
| 1859 | 13299 | 700843946H1 | SOYMON021 | g1435021 | BLASTN | 202 | 1e-29 | 57 |
| 1860 | 13299 | 700984301H1 | SOYMON009 | g1435021 | BLASTN | 95 | 1e-17 | 60 |
| 1861 | 13299 | 701121896H1 | SOYMON037 | g1435021 | BLASTN | 176 | 1e-25 | 58 |
| 1862 | 13299 | LIB3040-007-Q1-E1-A1 | LIB3040 | g1435021 | BLASTN | 133 | 1e-36 | 46 |
| 2159 | 1346 | 700605422H2 | SOYMON004 | g1052960 | BLASTN | 120 | 1e-18 | 94 |
| 2160 | 1346 | 700727420H1 | SOYMON009 | g1052960 | BLASTN | 123 | 1e-18 | 88 |
| 2161 | 1346 | 700753279H1 | SOYMON014 | g1052960 | BLASTN | 118 | 1e-18 | 88 |
| 2162 | 1346 | 700788035H1 | SOYMON011 | g1033195 | BLASTN | 91 | 1e-17 | 73 |
| 2163 | 1346 | 701000501H1 | SOYMON018 | g1052960 | BLASTN | 125 | 1e-19 | 86 |
| 2164 | 1346 | 701105155H1 | SOYMON036 | g1052960 | BLASTN | 150 | 1e-22 | 96 |
| 2165 | 1346 | 701206569H1 | SOYMON035 | g1052960 | BLASTN | 120 | 1e-18 | 66 |
| 2166 | 13656 | 700666194H1 | SOYMON005 | g19275 | BLASTN | 135 | 1e-26 | 51 |
| 2167 | 13656 | 700837919H1 | SOYMON020 | g19275 | BLASTN | 95 | 1e-18 | 39 |
| 2168 | 13933 | 700992117H1 | SOYMON011 | g1806260 | BLASTN | 560 | 1e-37 | 78 |
| 2169 | 13933 | 701104234H1 | SOYMON036 | g1122224 | BLASTN | 642 | 1e-44 | 79 |
| 2170 | 14568 | 700761703H1 | SOYMON015 | g2244743 | BLASTN | 250 | 1e-09 | 76 |
| 2171 | 14568 | 700954176H1 | SOYMON022 | g2244743 | BLASTN | 286 | 1e-12 | 70 |
| 2172 | 14792 | 700753907H1 | SOYMON014 | g2281448 | BLASTN | 624 | 1e-43 | 73 |
| 2173 | 14792 | 700753986H1 | SOYMON014 | g2281448 | BLASTN | 600 | 1e-41 | 74 |
| 2174 | 15359 | 700727763H1 | SOYMON009 | g2253277 | BLASTN | 593 | 1e-40 | 73 |
| 2175 | 15359 | 700727779H1 | SOYMON009 | g2253277 | BLASTN | 583 | 1e-39 | 74 |
| 2176 | 15359 | 700848841H1 | SOYMON021 | g2253277 | BLASTN | 756 | 1e-54 | 79 |
| 2177 | 15359 | 701102682H1 | SOYMON028 | g2253277 | BLASTN | 561 | 1e-37 | 75 |
| 2178 | 15361 | 700562280H1 | SOYMON002 | g1769890 | BLASTN | 258 | 1e-10 | 83 |
| 2179 | 15361 | 700676747H1 | SOYMON007 | g1769890 | BLASTN | 252 | 1e-10 | 83 |
| 2180 | 15361 | 700975661H1 | SOYMON009 | g1769890 | BLASTN | 242 | 1e-09 | 80 |
| 1869 | 15688 | 700979909H1 | SOYMON009 | g1165131 | BLASTN | 338 | 1e-21 | 72 |
| 2181 | 16380 | 700557554H1 | SOYMON001 | g1052959 | BLASTN | 691 | 1e-48 | 85 |
| 2182 | 16380 | 700557785H1 | SOYMON001 | g1052959 | BLASTN | 687 | 1e-63 | 82 |
| 2183 | 16380 | 700742445H1 | SOYMON012 | g1052959 | BLASTN | 697 | 1e-49 | 85 |
| 2184 | 16380 | 700980606H1 | SOYMON009 | g1052959 | BLASTN | 910 | 1e-67 | 80 |
| 1878 | 1658 | 700559250H1 | SOYMON001 | g767697 | BLASTN | 268 | 1e-11 | 79 |
| 1879 | 1658 | 700565790H1 | SOYMON002 | g767697 | BLASTN | 247 | 1e-10 | 76 |
| 1881 | 1658 | 700673109H1 | SOYMON006 | g767697 | BLASTN | 261 | 1e-10 | 77 |
| 1882 | 1658 | 700685043H1 | SOYMON008 | g767697 | BLASTN | 259 | 1e-10 | 77 |
| 1883 | 1658 | 700686169H1 | SOYMON008 | g767697 | BLASTN | 268 | 1e-11 | 79 |
| 1884 | 1658 | 700741361H1 | SOYMON012 | g767697 | BLASTN | 268 | 1e-11 | 79 |
| 1885 | 1658 | 700749356H1 | SOYMON013 | g767697 | BLASTN | 268 | 1e-11 | 79 |
| 1886 | 1658 | 700797949H1 | SOYMON017 | g767697 | BLASTN | 261 | 1e-10 | 77 |
| 1887 | 1658 | 700833223H1 | SOYMON019 | g767697 | BLASTN | 268 | 1e-11 | 79 |
| 1888 | 1658 | 700834106H1 | SOYMON019 | g767697 | BLASTN | 268 | 1e-11 | 79 |
| 1889 | 1658 | 700845743H1 | SOYMON021 | g767697 | BLASTN | 261 | 1e-10 | 77 |
| 1890 | 1658 | 700848684H1 | SOYMON021 | g767697 | BLASTN | 254 | 1e-10 | 76 |
| 1892 | 1658 | 700906912H1 | SOYMON022 | g767697 | BLASTN | 261 | 1e-10 | 77 |
| 1893 | 1658 | 700952665H1 | SOYMON022 | g767697 | BLASTN | 261 | 1e-10 | 77 |
| 1894 | 1658 | 700974873H1 | SOYMON005 | g767697 | BLASTN | 268 | 1e-11 | 79 |
| 1895 | 1658 | 700997270H1 | SOYMON018 | g767697 | BLASTN | 268 | 1e-11 | 79 |
| 1896 | 1658 | 701012341H1 | SOYMON019 | g767697 | BLASTN | 261 | 1e-12 | 79 |

-continued

SOYBEAN LEUCINE ZIPPER TRANSCRIPTION FACTORS

| Seq No. | Cluster ID | CloneID | Library | NCBI gi | METHOD | Score | P-Value | % Ident |
|---|---|---|---|---|---|---|---|---|
| 1898 | 1658 | 701041243H1 | SOYMON029 | g767697 | BLASTN | 268 | 1e-11 | 79 |
| 1899 | 1658 | 701042768H1 | SOYMON029 | g767697 | BLASTN | 268 | 1e-11 | 79 |
| 1901 | 1658 | 701063152H1 | SOYMON033 | g767697 | BLASTN | 268 | 1e-11 | 79 |
| 1902 | 1658 | 701102929H1 | SOYMON028 | g767697 | BLASTN | 240 | 1e-09 | 74 |
| 1903 | 1658 | 701106204H1 | SOYMON036 | g767697 | BLASTN | 261 | 1e-10 | 77 |
| 1905 | 1658 | 701149165H1 | SOYMON031 | g767697 | BLASTN | 259 | 1e-10 | 77 |
| 1906 | 1658 | LIB3055-007-Q1-N1-C5 | LIB3055 | g767697 | BLASTN | 268 | 1e-11 | 79 |
| 1907 | 1658 | LIB3040-041-Q1-E1-A7 | LIB3040 | g767697 | BLASTN | 250 | 1e-09 | 78 |
| 2185 | 17462 | 700873358H1 | SOYMON018 | g1354856 | BLASTN | 613 | 1e-68 | 93 |
| 2186 | 17462 | 700875170H1 | SOYMON018 | g1354856 | BLASTN | 688 | 1e-71 | 91 |
| 2187 | 17462 | 701009071H1 | SOYMON019 | g1354856 | BLASTN | 678 | 1e-78 | 92 |
| 1909 | 17759 | 700944041H1 | SOYMON024 | g1435021 | BLASTN | 186 | 1e-27 | 65 |
| 1910 | 17759 | 700962082H1 | SOYMON022 | g1435021 | BLASTN | 176 | 1e-25 | 62 |
| 1911 | 17759 | 700989672H1 | SOYMON011 | g767697 | BLASTN | 516 | 1e-34 | 66 |
| 1912 | 17759 | 701132610H1 | SOYMON038 | g767695 | BLASTN | 362 | 1e-34 | 71 |
| 2188 | 18428 | 700663968H1 | SOYMON005 | g21634 | BLASTN | 385 | 1e-21 | 71 |
| 2189 | 18428 | 701105724H1 | SOYMON036 | g21634 | BLASTN | 220 | 1e-13 | 79 |
| 2190 | 18829 | 700865466H1 | SOYMON016 | g2104674 | BLASTN | 867 | 1e-63 | 79 |
| 2191 | 18829 | 700869767H1 | SOYMON016 | g2104674 | BLASTN | 882 | 1e-64 | 81 |
| 2192 | 19335 | 700680951H1 | SOYMON008 | g21634 | BLASTN | 353 | 1e-18 | 70 |
| 2193 | 19537 | 700679859H1 | SOYMON007 | g1769891 | BLASTN | 236 | 1e-36 | 64 |
| 2194 | 19537 | 701041921H1 | SOYMON029 | g1769891 | BLASTN | 175 | 1e-27 | 58 |
| 2195 | 19537 | 701099652H1 | SOYMON028 | g1769891 | BLASTN | 154 | 1e-43 | 69 |
| 2196 | 19537 | LIB3051-088-Q1-K1-F7 | LIB3051 | g1865679 | BLASTN | 253 | 1e-54 | 64 |
| 2197 | 19580 | 700678758H1 | SOYMON007 | g2244741 | BLASTN | 356 | 1e-18 | 71 |
| 2198 | 19580 | 700897588H1 | SOYMON027 | g394735 | BLASTN | 319 | 1e-15 | 80 |
| 2199 | 19841 | 700959859H1 | SOYMON022 | g600855 | BLASTN | 120 | 1e-18 | 36 |
| 2200 | 20008 | 700849537H1 | SOYMON021 | g21634 | BLASTN | 777 | 1e-55 | 79 |
| 2201 | 20396 | 700556282H1 | SOYMON001 | g1033194 | BLASTN | 909 | 1e-66 | 82 |
| 2202 | 20396 | 700681445H2 | SOYMON008 | g1052959 | BLASTN | 458 | 1e-55 | 81 |
| 2203 | 20396 | 701104460H1 | SOYMON036 | g1033194 | BLASTN | 676 | 1e-47 | 76 |
| 2204 | 20396 | 701107626H1 | SOYMON036 | g1033194 | BLASTN | 759 | 1e-54 | 77 |
| 2205 | 20396 | 701145282H1 | SOYMON031 | g1033194 | BLASTN | 472 | 1e-40 | 77 |
| 2206 | 20396 | 701215204H1 | SOYMON035 | g1033194 | BLASTN | 793 | 1e-57 | 83 |
| 2207 | 20815 | 700869282H1 | SOYMON016 | g1769891 | BLASTN | 293 | 1e-44 | 74 |
| 2208 | 20815 | 700871948H1 | SOYMON018 | g2244741 | BLASTN | 286 | 1e-13 | 70 |
| 2209 | 20815 | 700969992H1 | SOYMON005 | g1769891 | BLASTN | 174 | 1e-27 | 71 |
| 2210 | 20815 | 701007846H1 | SOYMON019 | g1769891 | BLASTN | 142 | 1e-22 | 69 |
| 2211 | 20815 | 701049420H1 | SOYMON032 | g2244741 | BLASTN | 285 | 1e-12 | 75 |
| 2212 | 20815 | 701214473H1 | SOYMON035 | g1769891 | BLASTN | 189 | 1e-29 | 66 |
| 2213 | 20815 | 701215050H1 | SOYMON035 | g2244741 | BLASTN | 268 | 1e-12 | 75 |
| 2214 | 20815 | LIB3053-001-Q1-B1-A11 | LIB3053 | g1865679 | BLASTN | 185 | 1e-48 | 48 |
| 2215 | 21267 | 700669496H1 | SOYMON006 | g19275 | BLASTN | 145 | 1e-22 | 39 |
| 1932 | 2236 | 700559386H1 | SOYMON001 | g1234899 | BLASTN | 1400 | 1e-108 | 98 |
| 1933 | 2236 | 700684212H1 | SOYMON008 | g1234899 | BLASTN | 230 | 1e-13 | 92 |
| 1934 | 2236 | 700684793H1 | SOYMON008 | g1234899 | BLASTN | 383 | 1e-73 | 98 |
| 1935 | 2236 | 700684939H1 | SOYMON008 | g1234899 | BLASTN | 784 | 1e-90 | 91 |
| 1936 | 2236 | 700897221H1 | SOYMON027 | g1234899 | BLASTN | 1104 | 1e-83 | 95 |
| 1937 | 2236 | 700909715H1 | SOYMON022 | g1234899 | BLASTN | 586 | 1e-89 | 100 |
| 1938 | 2236 | 701064059H1 | SOYMON034 | g1234899 | BLASTN | 1241 | 1e-94 | 98 |
| 2216 | 227 | 700662032H1 | SOYMON005 | g1060934 | BLASTN | 237 | 1e-08 | 78 |
| 2217 | 227 | 700835836H1 | SOYMON019 | g394735 | BLASTN | 233 | 1e-08 | 94 |
| 2218 | 227 | 700870756H1 | SOYMON018 | g394735 | BLASTN | 233 | 1e-08 | 94 |
| 2219 | 227 | 700872734H1 | SOYMON018 | g394735 | BLASTN | 233 | 1e-08 | 94 |
| 2220 | 227 | 700956305H1 | SOYMON022 | g394735 | BLASTN | 233 | 1e-08 | 94 |
| 2221 | 227 | 700961356H1 | SOYMON022 | g394735 | BLASTN | 233 | 1e-08 | 94 |
| 2222 | 227 | 701131689H1 | SOYMON038 | g1060934 | BLASTN | 237 | 1e-08 | 78 |
| 2223 | 23249 | 701044782H1 | SOYMON032 | g1806260 | BLASTN | 585 | 1e-39 | 73 |
| 2224 | 23249 | 701044786H1 | SOYMON032 | g1806260 | BLASTN | 482 | 1e-31 | 79 |
| 2225 | 23935 | 701152085H1 | SOYMON031 | g1769891 | BLASTN | 197 | 1e-30 | 53 |
| 2226 | 23935 | 701153866H1 | SOYMON031 | g1769891 | BLASTN | 167 | 1e-25 | 53 |
| 2227 | 23935 | LIB3049-042-Q1-E1-E6 | LIB3049 | g2244742 | BLASTN | 132 | 1e-47 | 38 |
| 2228 | 24581 | 700961244H1 | SOYMON022 | g19275 | BLASTN | 216 | 1e-31 | 63 |
| 2229 | 24581 | 701129832H1 | SOYMON037 | g19275 | BLASTN | 248 | 1e-38 | 62 |
| 1950 | 25474 | 701012028H1 | SOYMON019 | g1234899 | BLASTN | 618 | 1e-52 | 83 |
| 1951 | 25474 | 701012112H1 | SOYMON019 | g1234899 | BLASTN | 380 | 1e-31 | 71 |
| 1952 | 25474 | LIB3051-100-Q1-K1-D12 | LIB3051 | g1234900 | BLASTN | 157 | 1e-43 | 81 |
| 2230 | 25498 | 701130027H1 | SOYMON037 | g2281449 | BLASTN | 167 | 1e-24 | 44 |
| 1953 | 2561 | 700762637H1 | SOYMON015 | g1234899 | BLASTN | 263 | 1e-12 | 82 |

SOYBEAN LEUCINE ZIPPER TRANSCRIPTION FACTORS

| Seq No. | Cluster ID | CloneID | Library | NCBI gi | METHOD | Score | P-Value | % Ident |
|---|---|---|---|---|---|---|---|---|
| 1954 | 2561 | 700967837H1 | SOYMON033 | g1234899 | BLASTN | 265 | 1e-14 | 80 |
| 2231 | 25917 | 700787878H2 | SOYMON011 | g217826 | BLASTN | 325 | 1e-16 | 77 |
| 2232 | 25917 | 701005616H1 | SOYMON019 | g903687 | BLASTN | 385 | 1e-21 | 77 |
| 2233 | 2700 | 700731034H1 | SOYMON009 | g1354856 | BLASTN | 530 | 1e-54 | 82 |
| 2234 | 2700 | 700760836H1 | SOYMON015 | g1354856 | BLASTN | 242 | 1e-25 | 89 |
| 2235 | 2700 | 700847484H1 | SOYMON021 | g1354856 | BLASTN | 217 | 1e-34 | 93 |
| 2236 | 2700 | 700892170H1 | SOYMON024 | g1354856 | BLASTN | 497 | 1e-57 | 87 |
| 2237 | 27158 | LIB3051-035-Q1-K1-B8 | LIB3051 | g2959559 | BLASTN | 158 | 1e-39 | 41 |
| 1959 | 29318 | 701064091H1 | SOYMON034 | g1234899 | BLASTN | 212 | 1e-16 | 84 |
| 2238 | 3020 | 700727875H1 | SOYMON009 | g1052959 | BLASTN | 975 | 1e-72 | 86 |
| 2239 | 3020 | 700730234H1 | SOYMON009 | g1052959 | BLASTN | 887 | 1e-73 | 88 |
| 2240 | 3020 | 700742390H1 | SOYMON012 | g1052959 | BLASTN | 745 | 1e-53 | 89 |
| 2241 | 3020 | 700786187H2 | SOYMON011 | g1052959 | BLASTN | 983 | 1e-73 | 87 |
| 2242 | 3020 | 700997938H1 | SOYMON018 | g1052959 | BLASTN | 617 | 1e-54 | 86 |
| 2243 | 30395 | 700888570H1 | SOYMON024 | g19275 | BLASTN | 176 | 1e-26 | 47 |
| 1960 | 30433 | 701131088H1 | SOYMON038 | g767695 | BLASTN | 406 | 1e-23 | 75 |
| 1961 | 30433 | LIB3051-016-Q1-E1-G10 | LIB3051 | g767695 | BLASTN | 614 | 1e-40 | 71 |
| 2244 | 30871 | LIB3051-016-Q1-E1-F10 | LIB3051 | g1806261 | BLASTN | 117 | 1e-50 | 60 |
| 2245 | 31789 | 700968432H1 | SOYMON036 | g2264378 | BLASTN | 223 | 1e-32 | 53 |
| 1971 | 3353 | 700559837H1 | SOYMON001 | g767700 | BLASTN | 632 | 1e-43 | 74 |
| 1972 | 3353 | 700646560H1 | SOYMON014 | g767700 | BLASTN | 413 | 1e-54 | 77 |
| 1973 | 3353 | 700739015H1 | SOYMON012 | g1435023 | BLASTN | 189 | 1e-51 | 79 |
| 1974 | 3353 | 700763993H1 | SOYMON019 | g767700 | BLASTN | 648 | 1e-45 | 80 |
| 1975 | 3353 | 700832983H1 | SOYMON019 | g767700 | BLASTN | 637 | 1e-44 | 70 |
| 1976 | 3353 | 700863990H1 | SOYMON016 | g1435023 | BLASTN | 253 | 1e-38 | 65 |
| 1977 | 3353 | 700873703H1 | SOYMON018 | g767700 | BLASTN | 799 | 1e-57 | 77 |
| 1978 | 3353 | 700944678H1 | SOYMON024 | g767700 | BLASTN | 760 | 1e-54 | 78 |
| 1979 | 3353 | 701014184H1 | SOYMON019 | g767700 | BLASTN | 614 | 1e-56 | 76 |
| 1980 | 3353 | 701133677H2 | SOYMON038 | g767700 | BLASTN | 486 | 1e-51 | 74 |
| 1981 | 3353 | 701136948H1 | SOYMON038 | g767700 | BLASTN | 465 | 1e-28 | 75 |
| 1982 | 3353 | LIB3030-007-Q1-B1-A2 | LIB3030 | g767700 | BLASTN | 1081 | 1e-81 | 75 |
| 1983 | 3353 | LIB3051-002-Q1-E1-F10 | LIB3051 | g767700 | BLASTN | 874 | 1e-64 | 76 |
| 1984 | 3353 | LIB3051-015-Q1-E1-E9 | LIB3051 | g767700 | BLASTN | 953 | 1e-70 | 75 |
| 2246 | 3930 | 700786961H2 | SOYMON011 | g19275 | BLASTN | 170 | 1e-25 | 78 |
| 2247 | 3930 | 700831960H1 | SOYMON019 | g19275 | BLASTN | 147 | 1e-22 | 77 |
| 2248 | 3930 | 700952739H1 | SOYMON022 | g19275 | BLASTN | 164 | 1e-29 | 67 |
| 2249 | 3930 | 701012333H1 | SOYMON019 | g19275 | BLASTN | 147 | 1e-21 | 77 |
| 2250 | 3930 | 701037531H1 | SOYMON029 | g19275 | BLASTN | 159 | 1e-23 | 73 |
| 2251 | 3930 | 701106748H1 | SOYMON036 | g19275 | BLASTN | 163 | 1e-32 | 67 |
| 2252 | 3930 | 701120422H1 | SOYMON037 | g19275 | BLASTN | 163 | 1e-24 | 44 |
| 2253 | 3930 | LIB3030-011-Q1-B1-H9 | LIB3030 | g19275 | BLASTN | 153 | 1e-55 | 54 |
| 2254 | 3930 | LIB3049-007-Q1-E1-H11 | LIB3049 | g19275 | BLASTN | 170 | 1e-46 | 69 |
| 2255 | 3942 | 700563590H1 | SOYMON002 | g1060934 | BLASTN | 255 | 1e-10 | 86 |
| 2256 | 3942 | 700566102H1 | SOYMON002 | g1060934 | BLASTN | 270 | 1e-12 | 86 |
| 2257 | 3942 | 700676941H1 | SOYMON007 | g1060934 | BLASTN | 285 | 1e-12 | 82 |
| 2258 | 3942 | 700683676H1 | SOYMON008 | g1060934 | BLASTN | 271 | 1e-11 | 79 |
| 2259 | 3942 | 700747213H1 | SOYMON013 | g1060934 | BLASTN | 285 | 1e-12 | 82 |
| 2260 | 3942 | 700750280H1 | SOYMON013 | g2244743 | BLASTN | 263 | 1e-11 | 82 |
| 2261 | 3942 | 700807573H1 | SOYMON016 | g1060934 | BLASTN | 276 | 1e-11 | 80 |
| 2262 | 3942 | 700831802H1 | SOYMON019 | g1060934 | BLASTN | 244 | 1e-09 | 86 |
| 2263 | 3942 | 700868674H1 | SOYMON016 | g2244743 | BLASTN | 302 | 1e-14 | 71 |
| 2264 | 3942 | 700872614H1 | SOYMON018 | g1060934 | BLASTN | 244 | 1e-09 | 81 |
| 2265 | 3942 | 700899657H1 | SOYMON027 | g1060934 | BLASTN | 187 | 1e-08 | 80 |
| 2266 | 3942 | 700959339H1 | SOYMON022 | g2244743 | BLASTN | 242 | 1e-09 | 81 |
| 2267 | 3942 | 701099951H1 | SOYMON028 | g2244743 | BLASTN | 242 | 1e-13 | 73 |
| 2268 | 3942 | 701212286H1 | SOYMON035 | g2244743 | BLASTN | 256 | 1e-10 | 82 |
| 2269 | 3942 | LIB3055-011-Q1-N1-G6 | LIB3055 | g1060934 | BLASTN | 278 | 1e-24 | 78 |
| 2270 | 3942 | LIB3065-007-Q1-N1-B3 | LIB3065 | g1060934 | BLASTN | 269 | 1e-11 | 79 |
| 2271 | 3942 | LIB3050-006-Q1-E1-F10 | LIB3050 | g394735 | BLASTN | 246 | 1e-09 | 90 |
| 1990 | 5724 | LIB3030-002-Q1-B1-A10 | LIB3030 | g3153207 | BLASTN | 153 | 1e-45 | 57 |
| 2272 | 6898 | 700653220H1 | SOYMON003 | g1769890 | BLASTN | 237 | 1e-09 | 71 |
| 2273 | 6898 | 700662807H1 | SOYMON005 | g1769890 | BLASTN | 339 | 1e-17 | 71 |
| 2274 | 6898 | 701097528H1 | SOYMON028 | g1769890 | BLASTN | 328 | 1e-16 | 71 |

SOYBEAN LEUCINE ZIPPER TRANSCRIPTION FACTORS

| Seq No. | Cluster ID | CloneID | Library | NCBI gi | METHOD | Score | P-Value | % Ident |
|---|---|---|---|---|---|---|---|---|
| 1992 | 7300 | 700671024H1 | SOYMON006 | g1435023 | BLASTN | 149 | 1e−22 | 71 |
| 1993 | 7300 | 700788665H1 | SOYMON011 | g1435023 | BLASTN | 212 | 1e−32 | 75 |
| 1995 | 7661 | 700728721H1 | SOYMON009 | g767697 | BLASTN | 637 | 1e−44 | 75 |
| 1996 | 7661 | 700871987H1 | SOYMON018 | g767695 | BLASTN | 579 | 1e−39 | 76 |
| 1997 | 7661 | 700874351H1 | SOYMON018 | g767695 | BLASTN | 555 | 1e−37 | 74 |
| 1998 | 7661 | 700876296H1 | SOYMON018 | g1435021 | BLASTN | 190 | 1e−36 | 75 |
| 2275 | 826 | 700731927H1 | SOYMON010 | g2317905 | BLASTN | 115 | 1e−17 | 43 |

SOYBEAN ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 2276 | -700555204 | 700555204H1 | SOYMON001 | g1871188 | BLASTN | 84 | 1e−17 | 43 |
| 2277 | -700561617 | 700561617H1 | SOYMON002 | g1872521 | BLASTN | 147 | 1e−27 | 76 |
| 2278 | -700565304 | 700565304H1 | SOYMON002 | g1304599 | BLASTN | 127 | 1e−19 | 66 |
| 2279 | -700566572 | 700566572H1 | SOYMON002 | g2262138 | BLASTN | 243 | 1e−35 | 79 |
| 2280 | -700650851 | 700650851H1 | SOYMON003 | g2565032 | BLASTN | 109 | 1e−23 | 48 |
| 2281 | -700652923 | 700652923H1 | SOYMON003 | g170624 | BLASTN | 120 | 1e−18 | 63 |
| 2282 | -700663736 | 700663736H1 | SOYMON005 | g2191172 | BLASTN | 185 | 1e−27 | 77 |
| 2283 | -700675341 | 700675341H1 | SOYMON007 | g1800278 | BLASTN | 345 | 1e−35 | 72 |
| 2284 | -700677659 | 700677659H1 | SOYMON007 | g1871188 | BLASTN | 119 | 1e−18 | 66 |
| 2285 | -700678063 | 700678063H1 | SOYMON007 | g1946361 | BLASTN | 184 | 1e−27 | 57 |
| 2286 | -700678783 | 700678783H1 | SOYMON007 | g1321818 | BLASTN | 129 | 1e−22 | 62 |
| 2287 | -700683873 | 700683873H1 | SOYMON008 | g1872522 | BLASTN | 273 | 1e−12 | 63 |
| 2288 | -700685541 | 700685541H1 | SOYMON008 | g1360087 | BLASTN | 465 | 1e−30 | 75 |
| 2289 | -700686166 | 700686166H1 | SOYMON008 | g2340088 | BLASTN | 136 | 1e−24 | 59 |
| 2290 | -700734774 | 700734774H1 | SOYMON010 | g1871192 | BLASTN | 212 | 1e−48 | 67 |
| 2291 | -700740434 | 700740434H1 | SOYMON012 | g1321818 | BLASTN | 127 | 1e−22 | 55 |
| 2292 | -700746763 | 700746763H1 | SOYMON013 | g2191172 | BLASTN | 144 | 1e−21 | 62 |
| 2293 | -700748587 | 700748587H1 | SOYMON013 | g2191172 | BLASTN | 118 | 1e−29 | 56 |
| 2294 | -700749618 | 700749618H1 | SOYMON013 | g469801 | BLASTN | 123 | 1e−19 | 44 |
| 2295 | -700789055 | 700789055H2 | SOYMON011 | g1871192 | BLASTN | 137 | 1e−23 | 86 |
| 2296 | -700794491 | 700794491H1 | SOYMON017 | g2191172 | BLASTN | 172 | 1e−25 | 70 |
| 2297 | -700832582 | 700832582H1 | SOYMON019 | g2464919 | BLASTN | 139 | 1e−21 | 66 |
| 2298 | -700838102 | 700838102H1 | SOYMON020 | g1871192 | BLASTN | 76 | 1e−19 | 63 |
| 2299 | -700841015 | 700841015H1 | SOYMON020 | g1871192 | BLASTN | 194 | 1e−28 | 77 |
| 2300 | -700842983 | 700842983H1 | SOYMON020 | g1871192 | BLASTN | 85 | 1e−20 | 71 |
| 2301 | -700847070 | 700847070H1 | SOYMON021 | g18766 | BLASTN | 946 | 1e−70 | 87 |
| 2302 | -700849930 | 700849930H1 | SOYMON023 | g1800279 | BLASTN | 133 | 1e−24 | 88 |
| 2303 | -700852321 | 700852321H1 | SOYMON023 | g1360078 | BLASTN | 181 | 1e−35 | 78 |
| 2304 | -700854559 | 700854559H1 | SOYMON023 | g1871192 | BLASTN | 202 | 1e−29 | 66 |
| 2305 | -700856529 | 700856529H1 | SOYMON023 | g1228035 | BLASTN | 122 | 1e−25 | 43 |
| 2306 | -700865957 | 700865957H1 | SOYMON016 | g1871192 | BLASTN | 154 | 1e−23 | 53 |
| 2307 | -700867713 | 700867713H1 | SOYMON016 | g2340088 | BLASTN | 170 | 1e−25 | 68 |
| 2308 | -700868865 | 700868865H1 | SOYMON016 | g1871192 | BLASTN | 115 | 1e−19 | 54 |
| 2309 | -700874648 | 700874648H1 | SOYMON018 | g2058503 | BLASTN | 166 | 1e−11 | 86 |
| 2310 | -700877141 | 700877141H1 | SOYMON018 | g2262138 | BLASTN | 196 | 1e−29 | 90 |
| 2118 | -700888837 | 700888837H1 | SOYMON024 | g2104676 | BLASTN | 521 | 1e−34 | 78 |
| 2311 | -700891917 | 700891917H1 | SOYMON024 | g18819 | BLASTN | 271 | 1e−49 | 63 |
| 2312 | -700891991 | 700891991H1 | SOYMON024 | g1946361 | BLASTN | 104 | 1e−28 | 65 |
| 2313 | -700894722 | 700894722H1 | SOYMON024 | g1871192 | BLASTN | 96 | 1e−22 | 68 |
| 2314 | -700895992 | 700895992H1 | SOYMON027 | g2262176 | BLASTN | 241 | 1e−37 | 73 |
| 2315 | -700897127 | 700897127H1 | SOYMON027 | g2262138 | BLASTN | 182 | 1e−27 | 83 |
| 2316 | -700901918 | 700901918H1 | SOYMON027 | g1871192 | BLASTN | 206 | 1e−34 | 64 |
| 2317 | -700907410 | 700907410H1 | SOYMON022 | g558543 | BLASTN | 129 | 1e−19 | 100 |
| 2318 | -700909203 | 700909203H1 | SOYMON022 | g2582644 | BLASTN | 319 | 1e−15 | 70 |
| 2319 | -700909471 | 700909471H1 | SOYMON022 | g173142 | BLASTN | 174 | 1e−38 | 64 |
| 2320 | -700909487 | 700909487H1 | SOYMON022 | g2464919 | BLASTN | 161 | 1e−23 | 74 |
| 2321 | -700944619 | 700944619H1 | SOYMON024 | g1360077 | BLASTN | 570 | 1e−38 | 84 |
| 2322 | -700944719 | 700944719H1 | SOYMON024 | g18819 | BLASTN | 220 | 1e−32 | 71 |
| 2323 | -700953795 | 700953795H1 | SOYMON022 | g1871192 | BLASTN | 209 | 1e−38 | 70 |
| 2324 | -700965266 | 700965266H1 | SOYMON022 | g558542 | BLASTN | 323 | 1e−18 | 82 |
| 2325 | -700967654 | 700967654H1 | SOYMON032 | g170216 | BLASTN | 695 | 1e−64 | 84 |
| 2326 | -700969294 | 700969294H1 | SOYMON005 | g732811 | BLASTN | 162 | 1e−26 | 91 |
| 2327 | -700971208 | 700971208H1 | SOYMON005 | g1871192 | BLASTN | 116 | 1e−24 | 66 |
| 2328 | -700971551 | 700971551H1 | SOYMON005 | g558542 | BLASTN | 682 | 1e−88 | 94 |
| 2329 | -700972802 | 700972802H1 | SOYMON005 | g2708744 | BLASTN | 176 | 1e−31 | 59 |
| 2330 | -700974243 | 700974243H1 | SOYMON005 | g2464919 | BLASTN | 137 | 1e−20 | 63 |
| 2331 | -700974736 | 700974736H1 | SOYMON005 | g1359493 | BLASTN | 279 | 1e−43 | 77 |
| 2332 | -700974869 | 700974869H1 | SOYMON005 | g2708744 | BLASTN | 113 | 1e−35 | 68 |

SOYBEAN ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 2333 | -700976868 | 700976868H1 | SOYMON009 | g2340088 | BLASTN | 113 | 1e-17 | 35 |
| 2334 | -700978854 | 700978854H1 | SOYMON009 | g790679 | BLASTN | 61 | 1e-20 | 55 |
| 2335 | -700983348 | 700983348H1 | SOYMON009 | g1800279 | BLASTN | 68 | 1e-22 | 74 |
| 2336 | -700985382 | 700985382H1 | SOYMON009 | g2262176 | BLASTN | 78 | 1e-17 | 53 |
| 2337 | -700985727 | 700985727H1 | SOYMON009 | g790683 | BLASTN | 159 | 1e-28 | 70 |
| 2338 | -700987679 | 700987679H1 | SOYMON009 | g1871192 | BLASTN | 157 | 1e-23 | 60 |
| 2339 | -700992259 | 700992259H1 | SOYMON011 | g439493 | BLASTN | 265 | 1e-39 | 59 |
| 2340 | -700999030 | 700999030H1 | SOYMON018 | g1871192 | BLASTN | 80 | 1e-22 | 58 |
| 2341 | -700999496 | 700999496H1 | SOYMON018 | g2191172 | BLASTN | 153 | 1e-22 | 75 |
| 2342 | -701005606 | 701005606H1 | SOYMON019 | g1321818 | BLASTN | 122 | 1e-18 | 43 |
| 2343 | -701006247 | 701006247H2 | SOYMON019 | g2191172 | BLASTN | 121 | 1e-18 | 40 |
| 2344 | -701008075 | 701008075H1 | SOYMON019 | g1773040 | BLASTN | 99 | 1e-17 | 61 |
| 2345 | -701012848 | 701012848H1 | SOYMON019 | g1773040 | BLASTN | 177 | 1e-39 | 61 |
| 2346 | -701015424 | 701015424H1 | SOYMON019 | g2464919 | BLASTN | 201 | 1e-38 | 73 |
| 2347 | -701042157 | 701042157H1 | SOYMON029 | g1360078 | BLASTN | 82 | 1e-18 | 69 |
| 2348 | -701045915 | 701045915H1 | SOYMON032 | g18819 | BLASTN | 162 | 1e-24 | 71 |
| 2349 | -701046568 | 701046568H1 | SOYMON032 | g558543 | BLASTN | 119 | 1e-18 | 60 |
| 2350 | -701046893 | 701046893H1 | SOYMON032 | g2262176 | BLASTN | 119 | 1e-18 | 45 |
| 2351 | -701046954 | 701046954H1 | SOYMON032 | g1360086 | BLASTN | 168 | 1e-27 | 100 |
| 2352 | -701048894 | 701048894H1 | SOYMON032 | g2088668 | BLASTN | 124 | 1e-19 | 66 |
| 2353 | -701053977 | 701053977H1 | SOYMON032 | g2582642 | BLASTN | 442 | 1e-26 | 74 |
| 2354 | -701056738 | 701056738H1 | SOYMON032 | g1871192 | BLASTN | 116 | 1e-17 | 60 |
| 2355 | -701059201 | 701059201H1 | SOYMON033 | g558543 | BLASTN | 141 | 1e-37 | 58 |
| 2356 | -701063636 | 701063636H1 | SOYMON033 | g558542 | BLASTN | 350 | 1e-60 | 98 |
| 2357 | -701064826 | 701064826H1 | SOYMON034 | g2435518 | BLASTN | 125 | 1e-20 | 47 |
| 2358 | -701070093 | 701070093H2 | SOYMON034 | g2464919 | BLASTN | 107 | 1e-17 | 47 |
| 2359 | -701097644 | 701097644H1 | SOYMON028 | g2340088 | BLASTN | 121 | 1e-22 | 67 |
| 2360 | -701103165 | 701103165H1 | SOYMON028 | g1360078 | BLASTN | 160 | 1e-24 | 68 |
| 2361 | -701103336 | 701103336H1 | SOYMON028 | g1418323 | BLASTN | 127 | 1e-24 | 60 |
| 2362 | -701105357 | 701105357H1 | SOYMON036 | g1871192 | BLASTN | 77 | 1e-21 | 57 |
| 2363 | -701108775 | 701108775H1 | SOYMON036 | g1297186 | BLASTN | 190 | 1e-28 | 82 |
| 2364 | -701110093 | 701110093H1 | SOYMON036 | g1871192 | BLASTN | 125 | 1e-19 | 81 |
| 2365 | -701121026 | 701121026H1 | SOYMON037 | g1786133 | BLASTN | 277 | 1e-28 | 84 |
| 2366 | -701121517 | 701121517H1 | SOYMON037 | g170216 | BLASTN | 483 | 1e-30 | 89 |
| 2367 | -701123152 | 701123152H1 | SOYMON037 | g1304599 | BLASTN | 208 | 1e-30 | 48 |
| 2368 | -701126225 | 701126225H1 | SOYMON037 | g1800279 | BLASTN | 182 | 1e-51 | 74 |
| 2369 | -701131709 | 701131709H1 | SOYMON038 | g2827537 | BLASTN | 141 | 1e-28 | 64 |
| 2370 | -701139073 | 701139073H1 | SOYMON038 | g1360084 | BLASTN | 152 | 1e-26 | 70 |
| 2371 | -701142618 | 701142618H1 | SOYMON038 | g732811 | BLASTN | 187 | 1e-29 | 89 |
| 2372 | -701203729 | 701203729H2 | SOYMON035 | g2262176 | BLASTN | 69 | 1e-18 | 48 |
| 2373 | -701205427 | 701205427H1 | SOYMON035 | g1321818 | BLASTN | 124 | 1e-19 | 30 |
| 2374 | -701205779 | 701205779H1 | SOYMON035 | g2262176 | BLASTN | 190 | 1e-32 | 55 |
| 2375 | -701208645 | 701208645H1 | SOYMON035 | g790679 | BLASTN | 159 | 1e-24 | 66 |
| 2376 | 10653 | LIB3029-002-Q1-B1-F9 | LIB3029 | g1871192 | BLASTN | 254 | 1e-53 | 52 |
| 2377 | 10760 | 700658055H1 | SOYMON004 | g1658054 | BLASTN | 125 | 1e-19 | 42 |
| 2378 | 10795 | LIB3039-004-Q1-E1-B1 | LIB3039 | g2190184 | BLASTN | 122 | 1e-33 | 48 |
| 2379 | 11064 | 700559483H1 | SOYMON001 | g1773040 | BLASTN | 164 | 1e-30 | 55 |
| 2380 | 11064 | 700726118H1 | SOYMON009 | g1773040 | BLASTN | 164 | 1e-24 | 56 |
| 2381 | 11064 | 700897260H1 | SOYMON027 | g1773040 | BLASTN | 157 | 1e-23 | 58 |
| 2382 | 11064 | LIB3039-035-Q1-E1-E9 | LIB3039 | g3152606 | BLASTN | 296 | 1e-67 | 77 |
| 2383 | 1182 | 700648937H1 | SOYMON003 | g1871192 | BLASTN | 82 | 1e-26 | 65 |
| 2384 | 1182 | 700654076H1 | SOYMON003 | g1871192 | BLASTN | 82 | 1e-18 | 64 |
| 2385 | 1182 | 701120146H1 | SOYMON037 | g1871192 | BLASTN | 86 | 1e-19 | 57 |
| 2386 | 12583 | 700674564H1 | SOYMON007 | g1871192 | BLASTN | 121 | 1e-28 | 60 |
| 2387 | 12583 | 701133796H1 | SOYMON038 | g1871192 | BLASTN | 122 | 1e-24 | 64 |
| 2388 | 1281 | 700553557H1 | SOYMON001 | g2058504 | BLASTN | 103 | 1e-23 | 59 |
| 2389 | 1281 | 700555485H1 | SOYMON001 | g439493 | BLASTN | 74 | 1e-22 | 82 |
| 2390 | 1281 | 700561288H1 | SOYMON002 | g2058504 | BLASTN | 62 | 1e-21 | 76 |
| 2391 | 1281 | 700563970H1 | SOYMON002 | g439489 | BLASTN | 94 | 1e-20 | 89 |
| 2392 | 1281 | 700654576H1 | SOYMON004 | g2058504 | BLASTN | 56 | 1e-18 | 69 |
| 2393 | 1281 | 700671995H1 | SOYMON006 | g2058504 | BLASTN | 103 | 1e-21 | 57 |
| 2394 | 1281 | 700683252H1 | SOYMON008 | g2058504 | BLASTN | 103 | 1e-23 | 59 |
| 2395 | 1281 | 700792684H1 | SOYMON017 | g2058504 | BLASTN | 103 | 1e-24 | 54 |
| 2396 | 1281 | 700794216H1 | SOYMON017 | g2058504 | BLASTN | 107 | 1e-23 | 56 |
| 2397 | 1281 | 700833508H1 | SOYMON019 | g439493 | BLASTN | 59 | 1e-19 | 82 |
| 2398 | 1281 | 700834525H1 | SOYMON019 | g2058504 | BLASTN | 103 | 1e-23 | 59 |
| 2399 | 1281 | 700898916H1 | SOYMON027 | g439493 | BLASTN | 74 | 1e-22 | 73 |
| 2400 | 1281 | 701006403H1 | SOYMON019 | g439489 | BLASTN | 66 | 1e-21 | 80 |
| 2401 | 1281 | 701012761H1 | SOYMON019 | g439493 | BLASTN | 73 | 1e-19 | 70 |
| 2402 | 1281 | 701046493H1 | SOYMON032 | g2058504 | BLASTN | 62 | 1e-20 | 76 |
| 2403 | 1281 | 701046591H1 | SOYMON032 | g439493 | BLASTN | 59 | 1e-19 | 82 |
| 2404 | 1281 | 701098180H1 | SOYMON028 | g2058504 | BLASTN | 99 | 1e-17 | 57 |

-continued

SOYBEAN ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 2405 | 1281 | 701100412H1 | SOYMON028 | g2058504 | BLASTN | 103 | 1e-23 | 59 |
| 2406 | 1281 | 701102104H1 | SOYMON028 | g2058504 | BLASTN | 103 | 1e-23 | 59 |
| 2407 | 1281 | 701110419H1 | SOYMON036 | g439493 | BLASTN | 73 | 1e-22 | 73 |
| 2408 | 1281 | 701119007H1 | SOYMON037 | g439493 | BLASTN | 77 | 1e-21 | 73 |
| 2409 | 1281 | 701125666H1 | SOYMON037 | g439493 | BLASTN | 74 | 1e-22 | 82 |
| 2410 | 1281 | 701127596H1 | SOYMON037 | g439493 | BLASTN | 74 | 1e-22 | 82 |
| 2411 | 1281 | 701129476H1 | SOYMON037 | g439493 | BLASTN | 67 | 1e-21 | 71 |
| 2412 | 1281 | 701147394H1 | SOYMON031 | g2058504 | BLASTN | 103 | 1e-20 | 58 |
| 2413 | 1281 | LIB3030-006-Q1-B1-D2 | LIB3030 | g2058504 | BLASTN | 103 | 1e-54 | 56 |
| 2414 | 1281 | LIB3050-003-Q1-E1-D4 | LIB3050 | g2058504 | BLASTN | 103 | 1e-41 | 53 |
| 2415 | 1281 | LIB3050-004-Q1-E1-B10 | LIB3050 | g439489 | BLASTN | 92 | 1e-35 | 69 |
| 2416 | 1281 | LIB3051-004-Q1-E1-G9 | LIB3051 | g439493 | BLASTN | 74 | 1e-38 | 82 |
| 2417 | 1281 | LIB3051-032-Q1-K1-H6 | LIB3051 | g439493 | BLASTN | 77 | 1e-46 | 70 |
| 2418 | 1281 | LIB3051-095-Q1-K1-G3 | LIB3051 | g439493 | BLASTN | 104 | 1e-49 | 70 |
| 2419 | 13705 | 700851990H1 | SOYMON023 | g558542 | BLASTN | 1168 | 1e-88 | 99 |
| 2420 | 13705 | 700992111H1 | SOYMON011 | g558542 | BLASTN | 1058 | 1e-79 | 98 |
| 2421 | 13705 | 701139534H1 | SOYMON038 | g558542 | BLASTN | 874 | 1e-91 | 98 |
| 2422 | 13798 | 700563706H1 | SOYMON002 | g1786134 | BLASTN | 101 | 1e-20 | 63 |
| 2423 | 13798 | 700829518H1 | SOYMON019 | g1786134 | BLASTN | 148 | 1e-27 | 68 |
| 2424 | 13798 | 700829718H1 | SOYMON019 | g1786134 | BLASTN | 137 | 1e-25 | 72 |
| 2425 | 13798 | 701054893H1 | SOYMON032 | g1418335 | BLASTN | 163 | 1e-24 | 56 |
| 2426 | 14138 | 700686353H1 | SOYMON008 | g2340087 | BLASTN | 347 | 1e-18 | 71 |
| 2427 | 14138 | 700751440H1 | SOYMON014 | g2340087 | BLASTN | 311 | 1e-15 | 68 |
| 2428 | 14138 | 700867874H1 | SOYMON016 | g2340087 | BLASTN | 361 | 1e-19 | 66 |
| 2429 | 14138 | 700900614H1 | SOYMON027 | g2340087 | BLASTN | 318 | 1e-15 | 62 |
| 2430 | 14138 | 701010759H1 | SOYMON019 | g2340087 | BLASTN | 347 | 1e-18 | 71 |
| 2431 | 14138 | 701037317H1 | SOYMON029 | g2340087 | BLASTN | 386 | 1e-21 | 64 |
| 2432 | 14138 | 701038681H1 | SOYMON029 | g2340087 | BLASTN | 346 | 1e-18 | 71 |
| 2433 | 14138 | LIB3065-002-Q1-N1-F7 | LIB3065 | g2340087 | BLASTN | 375 | 1e-21 | 66 |
| 2434 | 15560 | 700558649H1 | SOYMON001 | g1871192 | BLASTN | 147 | 1e-22 | 80 |
| 2435 | 16 | LIB3049-020-Q1-E1-D1 | LIB3049 | g1800278 | BLASTN | 226 | 1e-08 | 58 |
| 2436 | 16 | LIB3050-017-Q1-E1-F9 | LIB3050 | g790683 | BLASTN | 120 | 1e-35 | 59 |
| 2437 | 16 | LIB3050-024-Q1-K1-B11 | LIB3050 | g790679 | BLASTN | 107 | 1e-34 | 60 |
| 2438 | 16 | LIB3052-002-Q1-B1-A9 | LIB3052 | g1871192 | BLASTN | 125 | 1e-33 | 53 |
| 2439 | 16 | LIB3039-012-Q1-E1-D8 | LIB3039 | g1871192 | BLASTN | 125 | 1e-41 | 68 |
| 2440 | 16 | LIB3039-036-Q1-E1-E8 | LIB3039 | g1871192 | BLASTN | 139 | 1e-36 | 60 |
| 2441 | 16 | LIB3039-022-Q1-E1-D10 | LIB3039 | g2961542 | BLASTN | 144 | 1e-38 | 65 |
| 2442 | 16 | LIB3039-047-Q1-E1-G3 | LIB3039 | g1871192 | BLASTN | 111 | 1e-43 | 76 |
| 2443 | 17477 | 700846070H1 | SOYMON021 | g1800279 | BLASTN | 130 | 1e-20 | 95 |
| 2444 | 17477 | 700981868H1 | SOYMON009 | g1800279 | BLASTN | 253 | 1e-52 | 72 |
| 2445 | 18066 | 701122490H1 | SOYMON037 | g1418335 | BLASTN | 143 | 1e-25 | 68 |
| 2446 | 18242 | 700665667H1 | SOYMON005 | g2582643 | BLASTN | 126 | 1e-35 | 83 |
| 2447 | 18242 | 700834366H1 | SOYMON019 | g2582643 | BLASTN | 274 | 1e-50 | 79 |
| 2448 | 1880 | 700548213H1 | SOYMON002 | g1182006 | BLASTN | 668 | 1e-47 | 76 |
| 2449 | 1880 | 700560270H1 | SOYMON001 | g1182006 | BLASTN | 550 | 1e-37 | 78 |
| 2450 | 1880 | 700646501H1 | SOYMON014 | g1182006 | BLASTN | 632 | 1e-44 | 75 |
| 2451 | 1880 | 700655902H1 | SOYMON004 | g1182006 | BLASTN | 441 | 1e-27 | 75 |
| 2452 | 1880 | 700659785H1 | SOYMON004 | g1182006 | BLASTN | 579 | 1e-39 | 77 |
| 2453 | 1880 | 700660575H1 | SOYMON004 | g1182006 | BLASTN | 581 | 1e-39 | 76 |
| 2454 | 1880 | 700661543H1 | SOYMON005 | g1182006 | BLASTN | 690 | 1e-49 | 79 |
| 2455 | 1880 | 700662912H1 | SOYMON005 | g1182006 | BLASTN | 620 | 1e-43 | 76 |
| 2456 | 1880 | 700667516H1 | SOYMON006 | g1182006 | BLASTN | 490 | 1e-32 | 80 |
| 2457 | 1880 | 700740911H1 | SOYMON012 | g732811 | BLASTN | 174 | 1e-37 | 100 |
| 2458 | 1880 | 700744122H1 | SOYMON013 | g1182006 | BLASTN | 546 | 1e-36 | 75 |
| 2459 | 1880 | 700745185H1 | SOYMON013 | g732811 | BLASTN | 158 | 1e-43 | 91 |
| 2460 | 1880 | 700748385H1 | SOYMON013 | g1182006 | BLASTN | 566 | 1e-38 | 79 |
| 2461 | 1880 | 700754532H1 | SOYMON014 | g1182006 | BLASTN | 448 | 1e-28 | 66 |
| 2462 | 1880 | 700830859H1 | SOYMON019 | g1182006 | BLASTN | 572 | 1e-39 | 76 |
| 2463 | 1880 | 700853549H1 | SOYMON023 | g1182006 | BLASTN | 557 | 1e-37 | 79 |
| 2464 | 1880 | 700863521H1 | SOYMON027 | g1182006 | BLASTN | 499 | 1e-32 | 83 |

SOYBEAN ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 2465 | 1880 | 700960365H1 | SOYMON022 | g1182006 | BLASTN | 641 | 1e−45 | 76 |
| 2466 | 1880 | 700972326H1 | SOYMON005 | g1182006 | BLASTN | 621 | 1e−43 | 76 |
| 2467 | 1880 | 700973675H1 | SOYMON005 | g1182006 | BLASTN | 614 | 1e−42 | 76 |
| 2468 | 1880 | 700993904H1 | SOYMON011 | g1182006 | BLASTN | 371 | 1e−40 | 77 |
| 2469 | 1880 | 701007769H1 | SOYMON019 | g1182006 | BLASTN | 377 | 1e−21 | 83 |
| 2470 | 1880 | 701038517H1 | SOYMON029 | g1182006 | BLASTN | 678 | 1e−48 | 78 |
| 2471 | 1880 | 701041906H1 | SOYMON029 | g1182006 | BLASTN | 408 | 1e−23 | 81 |
| 2472 | 1880 | 701043891H1 | SOYMON032 | g732811 | BLASTN | 81 | 1e−39 | 75 |
| 2473 | 1880 | 701047838H1 | SOYMON032 | g1182006 | BLASTN | 520 | 1e−34 | 77 |
| 2474 | 1880 | 701047926H1 | SOYMON032 | g1182006 | BLASTN | 659 | 1e−46 | 76 |
| 2475 | 1880 | 701048273H1 | SOYMON032 | g1182006 | BLASTN | 550 | 1e−37 | 78 |
| 2476 | 1880 | 701050514H1 | SOYMON032 | g1182006 | BLASTN | 641 | 1e−45 | 78 |
| 2477 | 1880 | 701055331H1 | SOYMON032 | g1182006 | BLASTN | 568 | 1e−38 | 76 |
| 2478 | 1880 | 701055445H1 | SOYMON032 | g1182006 | BLASTN | 674 | 1e−47 | 75 |
| 2479 | 1880 | 701056851H1 | SOYMON032 | g1182006 | BLASTN | 599 | 1e−41 | 76 |
| 2480 | 1880 | 701061949H1 | SOYMON033 | g1182006 | BLASTN | 561 | 1e−50 | 80 |
| 2481 | 1880 | 701068587H1 | SOYMON034 | g1182006 | BLASTN | 649 | 1e−45 | 77 |
| 2482 | 1880 | 701098025H1 | SOYMON028 | g1182006 | BLASTN | 482 | 1e−40 | 78 |
| 2483 | 1880 | 701108025H1 | SOYMON036 | g1182006 | BLASTN | 602 | 1e−41 | 75 |
| 2484 | 1880 | 701124696H1 | SOYMON037 | g1182006 | BLASTN | 595 | 1e−41 | 75 |
| 2485 | 1880 | 701126996H1 | SOYMON037 | g1182006 | BLASTN | 377 | 1e−21 | 83 |
| 2486 | 1880 | 701139447H1 | SOYMON038 | g1182006 | BLASTN | 690 | 1e−49 | 75 |
| 2487 | 1880 | 701152229H1 | SOYMON031 | g732811 | BLASTN | 168 | 1e−37 | 84 |
| 2488 | 1880 | 701156733H1 | SOYMON031 | g1182006 | BLASTN | 435 | 1e−37 | 76 |
| 2489 | 1880 | 701204404H2 | SOYMON035 | g1182006 | BLASTN | 580 | 1e−39 | 79 |
| 2490 | 1880 | 701204619H1 | SOYMON035 | g1182006 | BLASTN | 527 | 1e−35 | 82 |
| 2491 | 1880 | 701207274H1 | SOYMON035 | g732811 | BLASTN | 72 | 1e−24 | 97 |
| 2492 | 1880 | 701212436H1 | SOYMON035 | g1182006 | BLASTN | 540 | 1e−36 | 75 |
| 2493 | 1880 | 701215258H1 | SOYMON035 | g1182006 | BLASTN | 509 | 1e−33 | 79 |
| 2494 | 1880 | LIB3054-002-Q1-N1-E7 | LIB3054 | g1182006 | BLASTN | 636 | 1e−45 | 74 |
| 2495 | 1880 | LIB3056-009-Q1-N1-A1 | LIB3056 | g1182006 | BLASTN | 720 | 1e−49 | 76 |
| 2496 | 1880 | LIB3040-047-Q1-E1-A4 | LIB3040 | g1182006 | BLASTN | 711 | 1e−50 | 74 |
| 2497 | 1880 | LIB3073-011-Q1-K1-G9 | LIB3073 | g1182006 | BLASTN | 692 | 1e−47 | 75 |
| 2498 | 1934 | 700730232H1 | SOYMON009 | g2708744 | BLASTN | 231 | 1e−33 | 65 |
| 2499 | 20802 | 700845749H1 | SOYMON021 | g1871192 | BLASTN | 85 | 1e−19 | 70 |
| 2500 | 20802 | 701205741H1 | SOYMON035 | g1800278 | BLASTN | 352 | 1e−18 | 66 |
| 2501 | 20802 | 701206823H1 | SOYMON035 | g1871192 | BLASTN | 238 | 1e−34 | 65 |
| 2502 | 20802 | LIB3049-008-Q1-E1-D2 | LIB3049 | g1871192 | BLASTN | 303 | 1e−67 | 63 |
| 2503 | 20802 | LIB3049-010-Q1-E1-C3 | LIB3049 | g2961541 | BLASTN | 490 | 1e−29 | 63 |
| 2504 | 20802 | LIB3049-010-Q1-E1-H5 | LIB3049 | g2961541 | BLASTN | 480 | 1e−29 | 66 |
| 2505 | 22922 | LIB3051-111-Q1-K1-D5 | LIB3051 | g1001957 | BLASTN | 85 | 1e−33 | 34 |
| 2506 | 23562 | 701005785H1 | SOYMON019 | g18819 | BLASTN | 126 | 1e−19 | 66 |
| 2507 | 23562 | 701126015H1 | SOYMON037 | g18819 | BLASTN | 139 | 1e−28 | 68 |
| 2508 | 23562 | 701140094H1 | SOYMON038 | g18819 | BLASTN | 133 | 1e−20 | 67 |
| 2509 | 23562 | 701148650H1 | SOYMON031 | g18819 | BLASTN | 213 | 1e−35 | 53 |
| 2510 | 24654 | 701005127H1 | SOYMON019 | g899254 | BLASTN | 165 | 1e−29 | 51 |
| 2511 | 24654 | 701047038H1 | SOYMON032 | g1052593 | BLASTN | 115 | 1e−17 | 60 |
| 2512 | 24862 | 701098039H1 | SOYMON028 | g2191172 | BLASTN | 139 | 1e−21 | 61 |
| 2513 | 24862 | 701209121H1 | SOYMON035 | g2191172 | BLASTN | 132 | 1e−20 | 54 |
| 2514 | 24981 | 700954134H1 | SOYMON022 | g1871192 | BLASTN | 129 | 1e−19 | 59 |
| 2515 | 24981 | 701202677H1 | SOYMON035 | g1871192 | BLASTN | 157 | 1e−23 | 62 |
| 2516 | 24981 | 701202728H1 | SOYMON035 | g1871192 | BLASTN | 224 | 1e−32 | 62 |
| 2517 | 24981 | 701205769H1 | SOYMON035 | g1871192 | BLASTN | 220 | 1e−32 | 64 |
| 2518 | 24981 | LIB3049-046-Q1-E1-A5 | LIB3049 | g1800278 | BLASTN | 555 | 1e−50 | 72 |
| 2519 | 25044 | 701004822H1 | SOYMON019 | g1773040 | BLASTN | 154 | 1e−23 | 65 |
| 2520 | 25044 | 701048110H1 | SOYMON032 | g1773040 | BLASTN | 144 | 1e−22 | 66 |
| 2521 | 25044 | 701053310H1 | SOYMON032 | g1773040 | BLASTN | 154 | 1e−23 | 65 |
| 2522 | 25478 | 700897774H1 | SOYMON027 | g1872521 | BLASTN | 130 | 1e−20 | 70 |
| 2523 | 25478 | 701097643H1 | SOYMON028 | g1872521 | BLASTN | 172 | 1e−48 | 74 |
| 2524 | 25478 | 701118320H1 | SOYMON037 | g1872521 | BLASTN | 88 | 1e−31 | 67 |
| 2525 | 25478 | LIB3051-019-Q1-E1-H6 | LIB3051 | g1872521 | BLASTN | 172 | 1e−83 | 71 |
| 2526 | 25478 | LIB3051-112-Q1-K1-F11 | LIB3051 | g1872520 | BLASTN | 319 | 1e−33 | 74 |
| 2527 | 25641 | 700889154H1 | SOYMON024 | g1872521 | BLASTN | 206 | 1e−47 | 65 |
| 2528 | 25641 | 701123050H1 | SOYMON037 | g1872521 | BLASTN | 195 | 1e−52 | 73 |

SOYBEAN ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 2529 | 25641 | 701213617H1 | SOYMON035 | g1872521 | BLASTN | 168 | 1e-48 | 70 |
| 2530 | 27570 | 700763939H1 | SOYMON019 | g1418321 | BLASTN | 107 | 1e-22 | 74 |
| 2531 | 27570 | 701215156H1 | SOYMON035 | g1418321 | BLASTN | 112 | 1e-17 | 83 |
| 2532 | 27570 | LIB3049-004-Q1-E1-C9 | LIB3049 | g1418321 | BLASTN | 107 | 1e-43 | 74 |
| 2533 | 27699 | 700973538H1 | SOYMON005 | g1871181 | BLASTN | 170 | 1e-25 | 49 |
| 2534 | 27699 | 701120758H1 | SOYMON037 | g1871181 | BLASTN | 148 | 1e-22 | 49 |
| 2535 | 27990 | 701061558H1 | SOYMON033 | g170624 | BLASTN | 139 | 1e-21 | 51 |
| 2536 | 27990 | 701202348H1 | SOYMON035 | g22046 | BLASTN | 151 | 1e-26 | 55 |
| 2537 | 29584 | 701120964H1 | SOYMON037 | g1871192 | BLASTN | 191 | 1e-28 | 91 |
| 2538 | 3051 | 700995972H1 | SOYMON018 | g2827537 | BLASTN | 170 | 1e-25 | 82 |
| 2539 | 30836 | 701005910H1 | SOYMON019 | g847869 | BLASTN | 75 | 1e-19 | 52 |
| 2540 | 30864 | LIB3051-026-Q1-K1-B7 | LIB3051 | g3152598 | BLASTN | 198 | 1e-55 | 50 |
| 2541 | 30864 | LIB3051-046-Q1-K1-E4 | LIB3051 | g3152598 | BLASTN | 250 | 1e-54 | 51 |
| 2542 | 3180 | 700975648H1 | SOYMON009 | g1871192 | BLASTN | 94 | 1e-23 | 56 |
| 2543 | 3193 | 700558715H1 | SOYMON001 | g1871192 | BLASTN | 243 | 1e-35 | 82 |
| 2544 | 3193 | 700562132H1 | SOYMON002 | g1871192 | BLASTN | 291 | 1e-42 | 83 |
| 2545 | 3193 | 700562292H1 | SOYMON002 | g1871192 | BLASTN | 341 | 1e-49 | 84 |
| 2546 | 3193 | 700564404H1 | SOYMON002 | g1871192 | BLASTN | 98 | 1e-23 | 81 |
| 2547 | 3193 | 700830515H1 | SOYMON019 | g1871192 | BLASTN | 197 | 1e-41 | 73 |
| 2548 | 3193 | 700842727H1 | SOYMON020 | g1871192 | BLASTN | 225 | 1e-36 | 82 |
| 2549 | 3193 | 700901732H1 | SOYMON027 | g1871192 | BLASTN | 182 | 1e-26 | 84 |
| 2550 | 3193 | 700992739H1 | SOYMON011 | g1871192 | BLASTN | 219 | 1e-32 | 82 |
| 2551 | 3193 | LIB3055-013-Q1-N1-H2 | LIB3055 | g1871192 | BLASTN | 310 | 1e-64 | 76 |
| 2552 | 32309 | 700997523H1 | SOYMON018 | g558542 | BLASTN | 732 | 1e-89 | 94 |
| 2553 | 32309 | 701142559H1 | SOYMON038 | g558542 | BLASTN | 1043 | 1e-87 | 95 |
| 2554 | 32309 | 701209581H1 | SOYMON035 | g558542 | BLASTN | 1279 | 1e-97 | 99 |
| 2555 | 32309 | LIB3051-075-Q1-K1-F1 | LIB3051 | g558542 | BLASTN | 1432 | 1e-147 | 90 |
| 2556 | 32379 | 700848828H1 | SOYMON021 | g790681 | BLASTN | 118 | 1e-22 | 74 |
| 2557 | 32379 | LIB3050-011-Q1-E1-A8 | LIB3050 | g790683 | BLASTN | 159 | 1e-40 | 67 |
| 2558 | 32797 | 701152088H1 | SOYMON031 | g18819 | BLASTN | 129 | 1e-19 | 73 |
| 2559 | 32797 | LIB3028-028-Q1-B1-F3 | LIB3028 | g18818 | BLASTN | 361 | 1e-39 | 76 |
| 2560 | 3362 | 700566936H1 | SOYMON002 | g1519680 | BLASTN | 130 | 1e-19 | 40 |
| 2561 | 3362 | LIB3051-067-Q1-K1-C10 | LIB3051 | g1519680 | BLASTN | 93 | 1e-34 | 37 |
| 2562 | 33797 | LIB3049-043-Q1-E1-D3 | LIB3049 | g1800278 | BLASTN | 461 | 1e-27 | 69 |
| 2563 | 33866 | 700900218H1 | SOYMON027 | g1872521 | BLASTN | 156 | 1e-43 | 65 |
| 2564 | 33877 | 700891618H1 | SOYMON024 | g1359492 | BLASTN | 475 | 1e-30 | 84 |
| 2565 | 33877 | 701133410H1 | SOYMON038 | g1359492 | BLASTN | 640 | 1e-44 | 80 |
| 2566 | 33877 | LIB3049-006-Q1-E1-E5 | LIB3049 | g1359492 | BLASTN | 520 | 1e-32 | 83 |
| 2567 | 3605 | 700889233H1 | SOYMON024 | g558542 | BLASTN | 1106 | 1e-85 | 98 |
| 2568 | 3605 | 700957362H1 | SOYMON022 | g558542 | BLASTN | 1226 | 1e-93 | 98 |
| 2569 | 3726 | 700894655H1 | SOYMON024 | g170626 | BLASTN | 118 | 1e-18 | 41 |
| 2570 | 3726 | 700953353H1 | SOYMON022 | g170626 | BLASTN | 117 | 1e-18 | 41 |
| 2571 | 3765 | 700889620H1 | SOYMON024 | g18818 | BLASTN | 478 | 1e-31 | 76 |
| 2572 | 3765 | 700892932H1 | SOYMON024 | g18819 | BLASTN | 230 | 1e-35 | 57 |
| 2573 | 3765 | 700945128H1 | SOYMON024 | g18818 | BLASTN | 371 | 1e-20 | 78 |
| 2574 | 3960 | LIB3051-092-Q1-K1-D6 | LIB3051 | g1871192 | BLASTN | 139 | 1e-36 | 53 |
| 2575 | 4005 | 700751479H1 | SOYMON014 | g18819 | BLASTN | 205 | 1e-32 | 69 |
| 2576 | 4005 | 700900939H1 | SOYMON027 | g18819 | BLASTN | 123 | 1e-19 | 84 |
| 2577 | 4005 | 700983734H1 | SOYMON009 | g18818 | BLASTN | 446 | 1e-26 | 73 |
| 2578 | 43 | 700661433H1 | SOYMON005 | g2582644 | BLASTN | 492 | 1e-37 | 76 |
| 2579 | 43 | 700665940H1 | SOYMON005 | g2582644 | BLASTN | 500 | 1e-32 | 69 |
| 2580 | 43 | 700679313H1 | SOYMON007 | g2582645 | BLASTN | 140 | 1e-21 | 75 |
| 2581 | 43 | 700679621H1 | SOYMON007 | g2582644 | BLASTN | 608 | 1e-41 | 76 |
| 2582 | 43 | 700732987H1 | SOYMON010 | g2582644 | BLASTN | 617 | 1e-42 | 77 |
| 2583 | 43 | 700745396H1 | SOYMON013 | g2582644 | BLASTN | 643 | 1e-44 | 73 |
| 2584 | 43 | 700786767H2 | SOYMON011 | g2582644 | BLASTN | 496 | 1e-32 | 74 |
| 2585 | 43 | 700832956H1 | SOYMON019 | g2582644 | BLASTN | 576 | 1e-39 | 74 |
| 2586 | 43 | 700833090H1 | SOYMON019 | g2582645 | BLASTN | 119 | 1e-46 | 82 |
| 2587 | 43 | 700852690H1 | SOYMON023 | g2582644 | BLASTN | 615 | 1e-42 | 77 |
| 2588 | 43 | 700871613H1 | SOYMON018 | g2582644 | BLASTN | 553 | 1e-37 | 75 |
| 2589 | 43 | 700895424H1 | SOYMON027 | g2582644 | BLASTN | 599 | 1e-45 | 76 |
| 2590 | 43 | 700898842H1 | SOYMON027 | g2582644 | BLASTN | 651 | 1e-45 | 77 |
| 2591 | 43 | 700952338H1 | SOYMON022 | g2582644 | BLASTN | 517 | 1e-34 | 74 |
| 2592 | 43 | 700957994H1 | SOYMON022 | g2582644 | BLASTN | 466 | 1e-30 | 75 |

-continued

SOYBEAN ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 2593 | 43 | 700958434H1 | SOYMON022 | g2582644 | BLASTN | 483 | 1e−31 | 74 |
| 2594 | 43 | 700971177H1 | SOYMON005 | g2582644 | BLASTN | 644 | 1e−44 | 76 |
| 2595 | 43 | 700981132H1 | SOYMON009 | g2582644 | BLASTN | 371 | 1e−39 | 74 |
| 2596 | 43 | 700981955H1 | SOYMON009 | g2582642 | BLASTN | 666 | 1e−50 | 75 |
| 2597 | 43 | 700994013H1 | SOYMON011 | g2582644 | BLASTN | 523 | 1e−34 | 73 |
| 2598 | 43 | 701002346H1 | SOYMON018 | g2582644 | BLASTN | 483 | 1e−39 | 76 |
| 2599 | 43 | 701003166H1 | SOYMON019 | g2582644 | BLASTN | 470 | 1e−37 | 75 |
| 2600 | 43 | 701007185H1 | SOYMON019 | g2582644 | BLASTN | 368 | 1e−39 | 77 |
| 2601 | 43 | 701012169H1 | SOYMON019 | g2582644 | BLASTN | 549 | 1e−37 | 75 |
| 2602 | 43 | 701044148H1 | SOYMON032 | g2582645 | BLASTN | 200 | 1e−30 | 84 |
| 2603 | 43 | 701045496H1 | SOYMON032 | g2582645 | BLASTN | 135 | 1e−20 | 86 |
| 2604 | 43 | 701046086H1 | SOYMON032 | g2582642 | BLASTN | 352 | 1e−18 | 77 |
| 2605 | 43 | 701046342H1 | SOYMON032 | g2582642 | BLASTN | 352 | 1e−18 | 77 |
| 2606 | 43 | 701049048H1 | SOYMON032 | g2582645 | BLASTN | 199 | 1e−30 | 90 |
| 2607 | 43 | 701049248H1 | SOYMON032 | g2582644 | BLASTN | 626 | 1e−43 | 75 |
| 2608 | 43 | 701050570H1 | SOYMON032 | g2582644 | BLASTN | 597 | 1e−41 | 76 |
| 2609 | 43 | 701050624H1 | SOYMON032 | g2582644 | BLASTN | 428 | 1e−25 | 73 |
| 2610 | 43 | 701054914H1 | SOYMON032 | g2582645 | BLASTN | 181 | 1e−27 | 87 |
| 2611 | 43 | 701056721H1 | SOYMON032 | g2582644 | BLASTN | 597 | 1e−41 | 76 |
| 2612 | 43 | 701063094H1 | SOYMON033 | g2582644 | BLASTN | 629 | 1e−43 | 72 |
| 2613 | 43 | 701065046H1 | SOYMON034 | g2582642 | BLASTN | 573 | 1e−39 | 73 |
| 2614 | 43 | 701067168H1 | SOYMON034 | g2582645 | BLASTN | 199 | 1e−30 | 90 |
| 2615 | 43 | 701067268H1 | SOYMON034 | g2582644 | BLASTN | 560 | 1e−37 | 76 |
| 2616 | 43 | 701119538H1 | SOYMON037 | g2582644 | BLASTN | 377 | 1e−31 | 74 |
| 2617 | 43 | 701122809H1 | SOYMON037 | g2582642 | BLASTN | 696 | 1e−49 | 73 |
| 2618 | 43 | 701152278H1 | SOYMON031 | g2582645 | BLASTN | 98 | 1e−31 | 78 |
| 2619 | 43 | 701206931H1 | SOYMON035 | g2582644 | BLASTN | 651 | 1e−45 | 77 |
| 2620 | 43 | 701214953H1 | SOYMON035 | g2582644 | BLASTN | 635 | 1e−44 | 76 |
| 2621 | 43 | LIB3049-038-Q1-E1-G12 | LIB3049 | g2582642 | BLASTN | 452 | 1e−26 | 73 |
| 2622 | 43 | LIB3049-034-Q1-E1-E9 | LIB3049 | g2582642 | BLASTN | 694 | 1e−66 | 73 |
| 2623 | 43 | LIB3049-049-Q1-E1-F12 | LIB3049 | g2582642 | BLASTN | 370 | 1e−19 | 71 |
| 2624 | 43 | LIB3040-006-Q1-E1-E10 | LIB3040 | g2582644 | BLASTN | 644 | 1e−42 | 76 |
| 2625 | 43 | LIB3050-027-Q1-E1-C11 | LIB3050 | g2582642 | BLASTN | 589 | 1e−38 | 73 |
| 2626 | 43 | LIB3050-005-Q1-K1-B12 | LIB3050 | g2582642 | BLASTN | 471 | 1e−32 | 74 |
| 2627 | 43 | LIB3051-005-Q1-E1-D11 | LIB3051 | g2582642 | BLASTN | 694 | 1e−47 | 73 |
| 2628 | 43 | LIB3073-012-Q1-K1-D10 | LIB3073 | g2582642 | BLASTN | 660 | 1e−49 | 73 |
| 2629 | 4509 | 700794624H1 | SOYMON017 | g439493 | BLASTN | 158 | 1e−26 | 86 |
| 2630 | 4509 | 700898852H1 | SOYMON027 | g439489 | BLASTN | 129 | 1e−24 | 82 |
| 2631 | 4533 | 700657428H1 | SOYMON004 | g18819 | BLASTN | 174 | 1e−38 | 77 |
| 2632 | 4533 | 701011796H1 | SOYMON019 | g18819 | BLASTN | 63 | 1e−18 | 72 |
| 2633 | 4533 | LIB3065-006-Q1-N1-G4 | LIB3065 | g18819 | BLASTN | 132 | 1e−49 | 75 |
| 2634 | 456 | 700670931H1 | SOYMON006 | g2827537 | BLASTN | 133 | 1e−23 | 55 |
| 2635 | 456 | 700670945H1 | SOYMON006 | g2827537 | BLASTN | 152 | 1e−31 | 68 |
| 2636 | 456 | 700671202H1 | SOYMON006 | g2827537 | BLASTN | 204 | 1e−33 | 67 |
| 2637 | 4703 | 700796646H1 | SOYMON017 | g20546 | BLASTN | 94 | 1e−19 | 56 |
| 2638 | 4711 | 700863735H1 | SOYMON016 | g1871181 | BLASTN | 165 | 1e−24 | 62 |
| 2639 | 4711 | 700863770H1 | SOYMON016 | g1871181 | BLASTN | 129 | 1e−21 | 62 |
| 2640 | 4711 | LIB3051-006-Q1-E1-D9 | LIB3051 | g1871181 | BLASTN | 157 | 1e−39 | 62 |
| 2641 | 5017 | 700665084H1 | SOYMON005 | g2708747 | BLASTN | 68 | 1e−23 | 65 |
| 2642 | 5605 | 700556543H1 | SOYMON001 | g439493 | BLASTN | 67 | 1e−20 | 78 |
| 2643 | 5605 | 700559375H1 | SOYMON001 | g439493 | BLASTN | 79 | 1e−17 | 96 |
| 2644 | 5605 | 700792943H1 | SOYMON017 | g439487 | BLASTN | 60 | 1e−18 | 71 |
| 2645 | 5605 | 700793079H1 | SOYMON017 | g1565227 | BLASTN | 77 | 1e−24 | 58 |
| 2646 | 5605 | 700942660H1 | SOYMON024 | g439493 | BLASTN | 78 | 1e−20 | 70 |
| 2647 | 5605 | 700998853H1 | SOYMON018 | g1565227 | BLASTN | 105 | 1e−23 | 59 |
| 2648 | 5605 | 701002990H1 | SOYMON019 | g1418333 | BLASTN | 100 | 1e−18 | 58 |
| 2649 | 5605 | 701006905H1 | SOYMON019 | g439493 | BLASTN | 83 | 1e−19 | 61 |
| 2650 | 5605 | 701009724H1 | SOYMON019 | g439489 | BLASTN | 77 | 1e−23 | 67 |
| 2651 | 5605 | 701037760H1 | SOYMON029 | g1418333 | BLASTN | 101 | 1e−19 | 57 |
| 2652 | 5605 | 701038122H1 | SOYMON029 | g439493 | BLASTN | 73 | 1e−18 | 63 |
| 2653 | 5605 | 701040129H1 | SOYMON029 | g439493 | BLASTN | 81 | 1e−21 | 64 |
| 2654 | 5605 | 701041739H1 | SOYMON029 | g439493 | BLASTN | 79 | 1e−21 | 72 |
| 2655 | 5605 | 701045280H1 | SOYMON032 | g439493 | BLASTN | 138 | 1e−28 | 72 |
| 2656 | 5605 | 701050712H1 | SOYMON032 | g439487 | BLASTN | 60 | 1e−19 | 76 |
| 2657 | 5605 | 701050991H1 | SOYMON032 | g439489 | BLASTN | 60 | 1e−17 | 67 |

SOYBEAN ZINC FINGER TRANSCRIPTION FACTORS

| Seq No. | Cluster ID | CloneID | Library | NCBI gi | METHOD | Score | P-Value | % Ident |
|---|---|---|---|---|---|---|---|---|
| 2658 | 5605 | 701118923H1 | SOYMON037 | g439487 | BLASTN | 81 | 1e-17 | 79 |
| 2659 | 5605 | LIB3056-011-Q1-N1-D1 | LIB3056 | g439493 | BLASTN | 85 | 1e-37 | 64 |
| 2660 | 5605 | LIB3050-010-Q1-E1-F3 | LIB3050 | g439489 | BLASTN | 75 | 1e-43 | 85 |
| 2661 | 5605 | LIB3050-006-Q1-E1-A11 | LIB3050 | g439489 | BLASTN | 81 | 1e-47 | 80 |
| 2662 | 6457 | 700649024H1 | SOYMON003 | g1773040 | BLASTN | 169 | 1e-25 | 67 |
| 2663 | 6457 | 700673477H1 | SOYMON006 | g1773040 | BLASTN | 175 | 1e-26 | 58 |
| 2664 | 6457 | LIB3051-002-Q1-E1-E5 | LIB3051 | g3152606 | BLASTN | 273 | 1e-56 | 91 |
| 2665 | 6908 | 700751128H1 | SOYMON014 | g170216 | BLASTN | 905 | 1e-67 | 87 |
| 2666 | 6908 | 700834641H1 | SOYMON019 | g170216 | BLASTN | 907 | 1e-67 | 86 |
| 2667 | 6908 | 700954358H1 | SOYMON022 | g170216 | BLASTN | 689 | 1e-48 | 86 |
| 2668 | 6908 | 700962820H1 | SOYMON022 | g170216 | BLASTN | 958 | 1e-71 | 86 |
| 2669 | 6908 | 700974469H1 | SOYMON005 | g170216 | BLASTN | 575 | 1e-39 | 87 |
| 2670 | 6908 | 701069651H1 | SOYMON034 | g170216 | BLASTN | 1034 | 1e-78 | 87 |
| 2671 | 6908 | 701129908H1 | SOYMON037 | g170216 | BLASTN | 648 | 1e-54 | 85 |
| 2672 | 6908 | 701206795H1 | SOYMON035 | g170216 | BLASTN | 976 | 1e-73 | 86 |
| 2673 | 7696 | 700562612H1 | SOYMON002 | g1418335 | BLASTN | 86 | 1e-17 | 61 |
| 2674 | 7696 | 701125488H1 | SOYMON037 | g1418335 | BLASTN | 135 | 1e-23 | 67 |
| 2675 | 8503 | 700562225H1 | SOYMON002 | g1871181 | BLASTN | 122 | 1e-18 | 40 |
| 2676 | 8668 | 700898523H1 | SOYMON027 | g1871192 | BLASTN | 82 | 1e-20 | 55 |
| 2677 | 8668 | 700900105H1 | SOYMON027 | g1871192 | BLASTN | 81 | 1e-20 | 58 |
| 2678 | 8847 | 700846721H1 | SOYMON021 | g1872521 | BLASTN | 120 | 1e-26 | 58 |
| 2679 | 8847 | 701067278H1 | SOYMON034 | g1872521 | BLASTN | 91 | 1e-22 | 60 |
| 2680 | 9230 | 700870827H1 | SOYMON018 | g1871192 | BLASTN | 99 | 1e-29 | 63 |
| 2681 | 9230 | 700872790H1 | SOYMON018 | g1871192 | BLASTN | 93 | 1e-20 | 72 |
| 2682 | 9230 | 700904566H1 | SOYMON022 | g1871192 | BLASTN | 115 | 1e-22 | 59 |
| 2683 | 9230 | 700951993H1 | SOYMON022 | g1871192 | BLASTN | 121 | 1e-26 | 64 |
| 2684 | 9230 | 700957717H1 | SOYMON022 | g1871192 | BLASTN | 93 | 1e-24 | 70 |
| 2685 | 9230 | LIB3030-008-Q1-B1-G5 | LIB3030 | g1871192 | BLASTN | 115 | 1e-56 | 63 |
| 2686 | 978 | 700992302H1 | SOYMON011 | g1871192 | BLASTN | 79 | 1e-18 | 57 |

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 2687 | -700548142 | 700548142H1 | SOYMON002 | g19492 | BLASTN | 114 | 1e-30 | 61 |
| 2688 | -700548235 | 700548235H1 | SOYMON002 | g16429 | BLASTN | 132 | 1e-20 | 80 |
| 2689 | -700554268 | 700554268H1 | SOYMON001 | g2398526 | BLASTN | 444 | 1e-26 | 79 |
| 2690 | -700555970 | 700555970H1 | SOYMON001 | g286023 | BLASTN | 111 | 1e-20 | 47 |
| 2691 | -700559531 | 700559531H1 | SOYMON001 | g1899058 | BLASTN | 130 | 1e-31 | 56 |
| 2692 | -700563522 | 700563522H1 | SOYMON002 | g1100994 | BLASTN | 76 | 1e-18 | 48 |
| 2693 | -700565384 | 700565384H1 | SOYMON002 | g1905944 | BLASTN | 85 | 1e-20 | 42 |
| 2694 | -700565626 | 700565626H1 | SOYMON002 | g1732246 | BLASTN | 433 | 1e-40 | 78 |
| 2695 | -700649584 | 700649584H1 | SOYMON003 | g2832408 | BLASTN | 88 | 1e-19 | 81 |
| 2696 | -700650943 | 700650943H1 | SOYMON003 | g2062174 | BLASTN | 181 | 1e-27 | 65 |
| 2697 | -700650945 | 700650945H1 | SOYMON003 | g2245059 | BLASTN | 240 | 1e-36 | 79 |
| 2698 | -700651862 | 700651862H1 | SOYMON003 | g1061146 | BLASTN | 74 | 1e-22 | 49 |
| 2699 | -700653241 | 700653241H1 | SOYMON003 | g2104680 | BLASTN | 424 | 1e-30 | 80 |
| 2700 | -700653418 | 700653418H1 | SOYMON003 | g2464855 | BLASTN | 198 | 1e-29 | 70 |
| 2701 | -700654319 | 700654319H1 | SOYMON004 | g1002799 | BLASTN | 493 | 1e-32 | 70 |
| 2702 | -700661747 | 700661747H1 | SOYMON005 | g1046277 | BLASTN | 580 | 1e-86 | 82 |
| 2703 | -700661861 | 700661861H1 | SOYMON005 | g2072499 | BLASTN | 167 | 1e-39 | 53 |
| 2704 | -700662360 | 700662360H1 | SOYMON005 | g2244754 | BLASTN | 126 | 1e-22 | 51 |
| 2705 | -700663241 | 700663241H1 | SOYMON005 | g2104680 | BLASTN | 257 | 1e-30 | 75 |
| 2706 | -700664220 | 700664220H1 | SOYMON005 | g1747310 | BLASTN | 240 | 1e-34 | 52 |
| 2707 | -700664496 | 700664496H1 | SOYMON005 | g289614 | BLASTN | 54 | 1e-17 | 44 |
| 2708 | -700664802 | 700664802H1 | SOYMON005 | g2145357 | BLASTN | 294 | 1e-20 | 84 |
| 2709 | -700668632 | 700668632H1 | SOYMON006 | g2104681 | BLASTN | 101 | 1e-24 | 65 |
| 2710 | -700669003 | 700669003H1 | SOYMON006 | g19260 | BLASTN | 130 | 1e-23 | 54 |
| 2711 | -700669892 | 700669892H1 | SOYMON006 | g2245134 | BLASTN | 138 | 1e-20 | 63 |
| 2712 | -700669961 | 700669961H1 | SOYMON006 | g2104687 | BLASTN | 73 | 1e-18 | 46 |
| 2713 | -700670315 | 700670315H1 | SOYMON006 | g1046277 | BLASTN | 533 | 1e-35 | 80 |
| 2714 | -700672413 | 700672413H1 | SOYMON006 | g2244754 | BLASTN | 209 | 1e-30 | 69 |
| 2715 | -700677068 | 700677068H1 | SOYMON007 | g1067169 | BLASTN | 126 | 1e-26 | 55 |
| 2716 | -700677709 | 700677709H1 | SOYMON007 | g2398521 | BLASTN | 150 | 1e-25 | 69 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 2717 | -700679268 | 700679268H1 | SOYMON007 | g1046277 | BLASTN | 339 | 1e-41 | 88 |
| 2718 | -700679384 | 700679384H1 | SOYMON007 | g1345404 | BLASTN | 111 | 1e-21 | 56 |
| 2719 | -700681638 | 700681638H1 | SOYMON008 | g1850792 | BLASTN | 511 | 1e-33 | 77 |
| 2720 | -700683746 | 700683746H1 | SOYMON008 | g1483227 | BLASTN | 443 | 1e-27 | 81 |
| 2721 | -700686588 | 700686588H1 | SOYMON008 | g2398522 | BLASTN | 281 | 1e-29 | 74 |
| 2722 | -700725253 | 700725253H1 | SOYMON009 | g662931 | BLASTN | 574 | 1e-60 | 89 |
| 2723 | -700725359 | 700725359H1 | SOYMON009 | g1183866 | BLASTN | 99 | 1e-24 | 70 |
| 2724 | -700728433 | 700728433H1 | SOYMON009 | g939778 | BLASTN | 680 | 1e-47 | 77 |
| 2725 | -700730484 | 700730484H1 | SOYMON009 | g662925 | BLASTN | 172 | 1e-13 | 86 |
| 2726 | -700733055 | 700733055H1 | SOYMON010 | g2245390 | BLASTN | 100 | 1e-18 | 58 |
| 2727 | -700733165 | 700733165H1 | SOYMON010 | g1046277 | BLASTN | 415 | 1e-37 | 87 |
| 2728 | -700734849 | 700734849H1 | SOYMON010 | g1707009 | BLASTN | 199 | 1e-36 | 59 |
| 2729 | -700735863 | 700735863H1 | SOYMON010 | g2398520 | BLASTN | 456 | 1e-28 | 68 |
| 2730 | -700737102 | 700737102H1 | SOYMON010 | g1046278 | BLASTN | 141 | 1e-21 | 96 |
| 2731 | -700738210 | 700738210H1 | SOYMON012 | g2702280 | BLASTN | 123 | 1e-18 | 50 |
| 2732 | -700738341 | 700738341H1 | SOYMON012 | g1049022 | BLASTN | 145 | 1e-22 | 58 |
| 2733 | -700738944 | 700738944H1 | SOYMON012 | g217859 | BLASTN | 145 | 1e-23 | 75 |
| 2734 | -700739430 | 700739430H1 | SOYMON012 | g20565 | BLASTN | 104 | 1e-19 | 64 |
| 2735 | -700740804 | 700740804H1 | SOYMON012 | g2104682 | BLASTN | 219 | 1e-08 | 85 |
| 2736 | -700743470 | 700743470H1 | SOYMON012 | g2245390 | BLASTN | 150 | 1e-22 | 55 |
| 2737 | -700745141 | 700745141H1 | SOYMON013 | g19380 | BLASTN | 133 | 1e-20 | 77 |
| 2738 | -700746472 | 700746472H1 | SOYMON013 | g2104678 | BLASTN | 1097 | 1e-82 | 93 |
| 2739 | -700749192 | 700749192H1 | SOYMON013 | g2443887 | BLASTN | 142 | 1e-22 | 53 |
| 2740 | -700749569 | 700749569H1 | SOYMON013 | g2398523 | BLASTN | 59 | 1e-18 | 52 |
| 2741 | -700750838 | 700750838H1 | SOYMON014 | g1899057 | BLASTN | 524 | 1e-34 | 74 |
| 2742 | -700753037 | 700753037H1 | SOYMON014 | g1100209 | BLASTN | 86 | 1e-24 | 55 |
| 2743 | -700754169 | 700754169H1 | SOYMON014 | g1046275 | BLASTN | 528 | 1e-35 | 84 |
| 2744 | -700757271 | 700757271H1 | SOYMON015 | g2443887 | BLASTN | 307 | 1e-44 | 70 |
| 2745 | -700757675 | 700757675H1 | SOYMON015 | g2196466 | BLASTN | 79 | 1e-24 | 59 |
| 2746 | -700759634 | 700759634H1 | SOYMON015 | g2511745 | BLASTN | 182 | 1e-26 | 52 |
| 2747 | -700760424 | 700760424H1 | SOYMON015 | g662923 | BLASTN | 917 | 1e-83 | 89 |
| 2748 | -700763862 | 700763862H1 | SOYMON018 | g2245390 | BLASTN | 144 | 1e-37 | 47 |
| 2749 | -700764012 | 700764012H1 | SOYMON019 | g1167485 | BLASTN | 636 | 1e-63 | 79 |
| 2750 | -700764321 | 700764321H1 | SOYMON021 | g2062174 | BLASTN | 79 | 1e-20 | 66 |
| 2751 | -700787754 | 700787754H2 | SOYMON011 | g1495708 | BLASTN | 106 | 1e-18 | 45 |
| 2752 | -700789356 | 700789356H2 | SOYMON011 | g437326 | BLASTN | 383 | 1e-50 | 79 |
| 2753 | -700793581 | 700793581H1 | SOYMON017 | g1749546 | BLASTN | 257 | 1e-37 | 72 |
| 2754 | -700793706 | 700793706H1 | SOYMON017 | g1483231 | BLASTN | 780 | 1e-56 | 76 |
| 2755 | -700795384 | 700795384H1 | SOYMON017 | g1345404 | BLASTN | 94 | 1e-23 | 47 |
| 2756 | -700795481 | 700795481H1 | SOYMON017 | g1263095 | BLASTN | 117 | 1e-18 | 54 |
| 2757 | -700795921 | 700795921H1 | SOYMON017 | g166592 | BLASTN | 537 | 1e-35 | 77 |
| 2758 | -700797043 | 700797043H1 | SOYMON017 | g1483227 | BLASTN | 653 | 1e-45 | 77 |
| 2759 | -700797092 | 700797092H1 | SOYMON017 | g862641 | BLASTN | 239 | 1e-09 | 78 |
| 2760 | -700797333 | 700797333H1 | SOYMON017 | g22379 | BLASTN | 230 | 1e-26 | 81 |
| 2761 | -700797418 | 700797418H1 | SOYMON017 | g22380 | BLASTN | 154 | 1e-23 | 91 |
| 2762 | -700797911 | 700797911H1 | SOYMON017 | g662929 | BLASTN | 968 | 1e-89 | 97 |
| 2763 | -700807587 | 700807587H1 | SOYMON016 | g662925 | BLASTN | 1676 | 1e-131 | 99 |
| 2764 | -700833091 | 700833091H1 | SOYMON019 | g2104681 | BLASTN | 88 | 1e-19 | 78 |
| 2765 | -700835092 | 700835092H1 | SOYMON019 | g1263097 | BLASTN | 185 | 1e-27 | 73 |
| 2766 | -700835579 | 700835579H1 | SOYMON019 | g662926 | BLASTN | 870 | 1e-63 | 98 |
| 2767 | -700835610 | 700835610H1 | SOYMON019 | g862650 | BLASTN | 109 | 1e-31 | 64 |
| 2768 | -700835640 | 700835640H1 | SOYMON019 | g1167484 | BLASTN | 169 | 1e-25 | 96 |
| 2769 | -700836749 | 700836749H1 | SOYMON020 | g2511745 | BLASTN | 134 | 1e-20 | 33 |
| 2770 | -700836955 | 700836955H1 | SOYMON020 | g1046277 | BLASTN | 1135 | 1e-85 | 96 |
| 2771 | -700840862 | 700840862H1 | SOYMON020 | g2832326 | BLASTN | 60 | 1e-18 | 70 |
| 2772 | -700846675 | 700846675H1 | SOYMON021 | g791053 | BLASTN | 135 | 1e-21 | 56 |
| 2773 | -700847152 | 700847152H1 | SOYMON021 | g2398524 | BLASTN | 467 | 1e-30 | 72 |
| 2774 | -700847154 | 700847154H1 | SOYMON021 | g2398523 | BLASTN | 134 | 1e-20 | 85 |
| 2775 | -700849851 | 700849851H1 | SOYMON021 | g1429225 | BLASTN | 448 | 1e-27 | 74 |
| 2776 | -700850388 | 700850388H1 | SOYMON023 | g1046277 | BLASTN | 421 | 1e-48 | 82 |
| 2777 | -700852080 | 700852080H1 | SOYMON023 | g2145358 | BLASTN | 176 | 1e-37 | 77 |
| 2778 | -700852477 | 700852477H1 | SOYMON023 | g19490 | BLASTN | 140 | 1e-20 | 71 |
| 2779 | -700854246 | 700854246H1 | SOYMON023 | g2398532 | BLASTN | 453 | 1e-29 | 75 |
| 2780 | -700854796 | 700854796H1 | SOYMON023 | g1046277 | BLASTN | 296 | 1e-35 | 81 |
| 2781 | -700854873 | 700854873H1 | SOYMON023 | g1439631 | BLASTN | 114 | 1e-21 | 50 |
| 2782 | -700865237 | 700865237H1 | SOYMON016 | g217859 | BLASTN | 145 | 1e-31 | 48 |
| 2783 | -700867051 | 700867051H1 | SOYMON016 | g1019924 | BLASTN | 645 | 1e-44 | 74 |
| 2784 | -700867684 | 700867684H1 | SOYMON016 | g1763062 | BLASTN | 974 | 1e-72 | 98 |
| 2785 | -700868479 | 700868479H1 | SOYMON016 | g2245134 | BLASTN | 218 | 1e-32 | 60 |
| 2786 | -700869544 | 700869544H1 | SOYMON016 | g19487 | BLASTN | 341 | 1e-36 | 76 |
| 2787 | -700870829 | 700870829H1 | SOYMON018 | g1532133 | BLASTN | 119 | 1e-18 | 59 |
| 2788 | -700872337 | 700872337H1 | SOYMON018 | g662925 | BLASTN | 483 | 1e-47 | 99 |
| 2789 | -700872727 | 700872727H1 | SOYMON018 | g2443887 | BLASTN | 299 | 1e-43 | 69 |
| 2790 | -700872828 | 700872828H1 | SOYMON018 | g19260 | BLASTN | 102 | 1e-25 | 70 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 2791 | -700872947 | 700872947H1 | SOYMON018 | g19260 | BLASTN | 138 | 1e-20 | 86 |
| 2792 | -700875596 | 700875596H1 | SOYMON018 | g1483229 | BLASTN | 365 | 1e-39 | 75 |
| 2793 | -700876085 | 700876085H1 | SOYMON018 | g1483231 | BLASTN | 329 | 1e-45 | 75 |
| 2794 | -700877254 | 700877254H1 | SOYMON018 | g1109830 | BLASTN | 97 | 1e-19 | 46 |
| 2795 | -700888138 | 700888138H1 | SOYMON024 | g2826884 | BLASTN | 66 | 1e-17 | 50 |
| 2796 | -700888167 | 700888167H1 | SOYMON024 | g2832479 | BLASTN | 423 | 1e-27 | 79 |
| 2797 | -700888183 | 700888183H1 | SOYMON024 | g217859 | BLASTN | 139 | 1e-21 | 48 |
| 2798 | -700889004 | 700889004H1 | SOYMON024 | g19380 | BLASTN | 135 | 1e-20 | 96 |
| 2799 | -700890148 | 700890148H1 | SOYMON024 | g1747309 | BLASTN | 643 | 1e-44 | 72 |
| 2800 | -700890210 | 700890210H1 | SOYMON024 | g1167485 | BLASTN | 575 | 1e-39 | 86 |
| 2801 | -700891367 | 700891367H1 | SOYMON024 | g1747309 | BLASTN | 612 | 1e-42 | 78 |
| 2802 | -700892430 | 700892430H1 | SOYMON024 | g19492 | BLASTN | 162 | 1e-24 | 67 |
| 2803 | -700894470 | 700894470H1 | SOYMON024 | g22379 | BLASTN | 480 | 1e-31 | 79 |
| 2804 | -700894554 | 700894554H1 | SOYMON024 | g2104678 | BLASTN | 961 | 1e-71 | 90 |
| 2805 | -700896693 | 700896693H1 | SOYMON027 | g19057 | BLASTN | 179 | 1e-33 | 57 |
| 2806 | -700896705 | 700896705H1 | SOYMON027 | g1370139 | BLASTN | 518 | 1e-34 | 67 |
| 2807 | -700898269 | 700898269H1 | SOYMON027 | g1483231 | BLASTN | 805 | 1e-58 | 80 |
| 2808 | -700900418 | 700900418H1 | SOYMON027 | g1763062 | BLASTN | 928 | 1e-86 | 84 |
| 2809 | -700905160 | 700905160H1 | SOYMON022 | g2245134 | BLASTN | 136 | 1e-20 | 89 |
| 2810 | -700906096 | 700906096H1 | SOYMON022 | g1483227 | BLASTN | 929 | 1e-68 | 83 |
| 2811 | -700906279 | 700906279H1 | SOYMON022 | g2088641 | BLASTN | 218 | 1e-31 | 72 |
| 2812 | -700907612 | 700907612H1 | SOYMON022 | g20563 | BLASTN | 156 | 1e-23 | 70 |
| 2813 | -700907805 | 700907805H1 | SOYMON022 | g2832407 | BLASTN | 518 | 1e-34 | 74 |
| 2814 | -700907885 | 700907885H1 | SOYMON022 | g1049023 | BLASTN | 420 | 1e-26 | 85 |
| 2815 | -700907958 | 700907958H1 | SOYMON022 | g2443887 | BLASTN | 148 | 1e-22 | 58 |
| 2816 | -700941440 | 700941440H1 | SOYMON024 | g19490 | BLASTN | 108 | 1e-24 | 50 |
| 2817 | -700942877 | 700942877H1 | SOYMON024 | g437326 | BLASTN | 518 | 1e-34 | 71 |
| 2818 | -700944108 | 700944108H1 | SOYMON024 | g662928 | BLASTN | 164 | 1e-25 | 81 |
| 2819 | -700944823 | 700944823H1 | SOYMON024 | g1167486 | BLASTN | 70 | 1e-17 | 54 |
| 2820 | -700944875 | 700944875H1 | SOYMON024 | g556408 | BLASTN | 323 | 1e-16 | 70 |
| 2821 | -700944913 | 700944913H1 | SOYMON024 | g556558 | BLASTN | 223 | 1e-34 | 82 |
| 2822 | -700952303 | 700952303H1 | SOYMON022 | g556557 | BLASTN | 904 | 1e-66 | 81 |
| 2823 | -700952476 | 700952476H1 | SOYMON022 | g20563 | BLASTN | 147 | 1e-32 | 62 |
| 2824 | -700953271 | 700953271H1 | SOYMON022 | g2702280 | BLASTN | 106 | 1e-23 | 53 |
| 2825 | -700955669 | 700955669H1 | SOYMON022 | g2459835 | BLASTN | 102 | 1e-17 | 95 |
| 2826 | -700955837 | 700955837H1 | SOYMON022 | g1002796 | BLASTN | 156 | 1e-25 | 71 |
| 2827 | -700956059 | 700956059H1 | SOYMON022 | g1206002 | BLASTN | 294 | 1e-27 | 86 |
| 2828 | -700956492 | 700956492H1 | SOYMON022 | g1239962 | BLASTN | 317 | 1e-16 | 83 |
| 2829 | -700956972 | 700956972H1 | SOYMON022 | g2245632 | BLASTN | 122 | 1e-18 | 41 |
| 2830 | -700957110 | 700957110H1 | SOYMON022 | g2196466 | BLASTN | 127 | 1e-22 | 71 |
| 2831 | -700957658 | 700957658H1 | SOYMON022 | g1841474 | BLASTN | 666 | 1e-46 | 79 |
| 2832 | -700958205 | 700958205H1 | SOYMON022 | g2245390 | BLASTN | 119 | 1e-18 | 76 |
| 2833 | -700960143 | 700960143H1 | SOYMON022 | g1841475 | BLASTN | 89 | 1e-25 | 70 |
| 2834 | -700962504 | 700962504H1 | SOYMON022 | g1749546 | BLASTN | 97 | 1e-25 | 54 |
| 2835 | -700963673 | 700963673H1 | SOYMON022 | g1239963 | BLASTN | 119 | 1e-18 | 82 |
| 2836 | -700964295 | 700964295H1 | SOYMON022 | g1420924 | BLASTN | 72 | 1e-17 | 51 |
| 2837 | -700968421 | 700968421H1 | SOYMON036 | g945087 | BLASTN | 142 | 1e-21 | 89 |
| 2838 | -700970839 | 700970839H1 | SOYMON005 | g1109828 | BLASTN | 117 | 1e-18 | 45 |
| 2839 | -700971221 | 700971221H1 | SOYMON005 | g2832543 | BLASTN | 289 | 1e-23 | 81 |
| 2840 | -700971962 | 700971962H1 | SOYMON005 | g16428 | BLASTN | 378 | 1e-20 | 73 |
| 2841 | -700972493 | 700972493H1 | SOYMON005 | g2564336 | BLASTN | 787 | 1e-56 | 80 |
| 2842 | -700972691 | 700972691H1 | SOYMON005 | g1890351 | BLASTN | 383 | 1e-39 | 78 |
| 2843 | -700973132 | 700973132H1 | SOYMON005 | g2245390 | BLASTN | 116 | 1e-28 | 63 |
| 2844 | -700973922 | 700973922H1 | SOYMON005 | g786426 | BLASTN | 65 | 1e-18 | 49 |
| 2845 | -700974916 | 700974916H1 | SOYMON005 | g928930 | BLASTN | 76 | 1e-27 | 55 |
| 2846 | -700976496 | 700976496H1 | SOYMON009 | g662931 | BLASTN | 435 | 1e-59 | 88 |
| 2847 | -700977203 | 700977203H1 | SOYMON009 | g1239962 | BLASTN | 253 | 1e-10 | 81 |
| 2848 | -700978443 | 700978443H1 | SOYMON009 | g662926 | BLASTN | 894 | 1e-73 | 94 |
| 2849 | -700979531 | 700979531H2 | SOYMON009 | g1239961 | BLASTN | 84 | 1e-20 | 54 |
| 2850 | -700979865 | 700979865H2 | SOYMON009 | g662926 | BLASTN | 955 | 1e-91 | 99 |
| 2851 | -700981106 | 700981106H1 | SOYMON009 | g2245390 | BLASTN | 148 | 1e-22 | 37 |
| 2852 | -700981889 | 700981889H1 | SOYMON009 | g928942 | BLASTN | 170 | 1e-29 | 68 |
| 2853 | -700983448 | 700983448H1 | SOYMON009 | g2104678 | BLASTN | 583 | 1e-81 | 90 |
| 2854 | -700983754 | 700983754H1 | SOYMON009 | g556557 | BLASTN | 260 | 1e-10 | 67 |
| 2855 | -700985623 | 700985623H1 | SOYMON009 | g1167486 | BLASTN | 144 | 1e-21 | 77 |
| 2856 | -700985923 | 700985923H1 | SOYMON009 | g1430845 | BLASTN | 660 | 1e-58 | 81 |
| 2857 | -700986140 | 700986140H1 | SOYMON009 | g2443887 | BLASTN | 289 | 1e-41 | 69 |
| 2858 | -700986876 | 700986876H1 | SOYMON009 | g662926 | BLASTN | 715 | 1e-90 | 94 |
| 2859 | -700991054 | 700991054H1 | SOYMON011 | g2505876 | BLASTN | 125 | 1e-21 | 82 |
| 2860 | -700992837 | 700992837H1 | SOYMON011 | g556557 | BLASTN | 503 | 1e-33 | 82 |
| 2861 | -700993724 | 700993724H1 | SOYMON011 | g2564336 | BLASTN | 933 | 1e-68 | 85 |
| 2862 | -700994373 | 700994373H1 | SOYMON011 | g2735765 | BLASTN | 509 | 1e-33 | 74 |
| 2863 | -700995761 | 700995761H1 | SOYMON011 | g2564336 | BLASTN | 719 | 1e-56 | 81 |
| 2864 | -700998422 | 700998422H1 | SOYMON018 | g2702280 | BLASTN | 157 | 1e-31 | 56 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 2865 | -701000406 | 701000406H1 | SOYMON018 | g1430845 | BLASTN | 827 | 1e-60 | 84 |
| 2866 | -701000444 | 701000444H1 | SOYMON018 | g1173615 | BLASTN | 738 | 1e-52 | 78 |
| 2867 | -701000607 | 701000607H1 | SOYMON018 | g2398525 | BLASTN | 198 | 1e-31 | 63 |
| 2868 | -701001157 | 701001157H1 | SOYMON018 | g2398526 | BLASTN | 484 | 1e-39 | 76 |
| 2869 | -701001268 | 701001268H1 | SOYMON018 | g2104687 | BLASTN | 114 | 1e-17 | 50 |
| 2870 | -701001671 | 701001671H1 | SOYMON018 | g437326 | BLASTN | 496 | 1e-32 | 84 |
| 2871 | -701001986 | 701001986H1 | SOYMON018 | g1146237 | BLASTN | 106 | 1e-18 | 45 |
| 2872 | -701002116 | 701002116H1 | SOYMON018 | g1049023 | BLASTN | 382 | 1e-27 | 77 |
| 2873 | -701005343 | 701005343H1 | SOYMON019 | g928928 | BLASTN | 198 | 1e-29 | 82 |
| 2874 | -701007423 | 701007423H2 | SOYMON019 | g2832407 | BLASTN | 391 | 1e-32 | 76 |
| 2875 | -701009414 | 701009414H1 | SOYMON019 | g928928 | BLASTN | 183 | 1e-27 | 88 |
| 2876 | -701010777 | 701010777H1 | SOYMON019 | g2443887 | BLASTN | 180 | 1e-31 | 82 |
| 2877 | -701014349 | 701014349H1 | SOYMON019 | g862649 | BLASTN | 501 | 1e-31 | 74 |
| 2878 | -701014944 | 701014944H1 | SOYMON019 | g2245389 | BLASTN | 307 | 1e-14 | 74 |
| 2879 | -701038792 | 701038792H1 | SOYMON029 | g2827708 | BLASTN | 140 | 1e-21 | 92 |
| 2880 | -701038959 | 701038959H1 | SOYMON029 | g662931 | BLASTN | 505 | 1e-80 | 96 |
| 2881 | -701040606 | 701040606H1 | SOYMON029 | g1732513 | BLASTN | 130 | 1e-28 | 66 |
| 2882 | -701042603 | 701042603H1 | SOYMON029 | g2104678 | BLASTN | 1215 | 1e-92 | 96 |
| 2883 | -701044385 | 701044385H1 | SOYMON032 | g1101769 | BLASTN | 485 | 1e-31 | 70 |
| 2884 | -701046304 | 701046304H1 | SOYMON032 | g1747309 | BLASTN | 241 | 1e-09 | 66 |
| 2885 | -701048469 | 701048469H1 | SOYMON032 | g945086 | BLASTN | 473 | 1e-30 | 97 |
| 2886 | -701052317 | 701052317H1 | SOYMON032 | g1101769 | BLASTN | 432 | 1e-25 | 75 |
| 2887 | -701053807 | 701053807H1 | SOYMON032 | g1171428 | BLASTN | 688 | 1e-48 | 73 |
| 2888 | -701054423 | 701054423H1 | SOYMON032 | g1617325 | BLASTN | 85 | 1e-19 | 65 |
| 2889 | -701054948 | 701054948H1 | SOYMON032 | g19051 | BLASTN | 97 | 1e-20 | 67 |
| 2890 | -701055890 | 701055890H1 | SOYMON032 | g2398526 | BLASTN | 429 | 1e-25 | 78 |
| 2891 | -701056060 | 701056060H1 | SOYMON032 | g2398530 | BLASTN | 480 | 1e-31 | 76 |
| 2892 | -701056537 | 701056537H1 | SOYMON032 | g2104678 | BLASTN | 736 | 1e-72 | 91 |
| 2893 | -701059373 | 701059373H1 | SOYMON033 | g1420924 | BLASTN | 302 | 1e-43 | 63 |
| 2894 | -701059890 | 701059890H1 | SOYMON033 | g1199574 | BLASTN | 611 | 1e-42 | 73 |
| 2895 | -701060607 | 701060607H1 | SOYMON033 | g19260 | BLASTN | 149 | 1e-22 | 81 |
| 2896 | -701062233 | 701062233H1 | SOYMON033 | g2673911 | BLASTN | 206 | 1e-30 | 66 |
| 2897 | -701066326 | 701066326H1 | SOYMON034 | g1430846 | BLASTN | 246 | 1e-36 | 72 |
| 2898 | -701067440 | 701067440H1 | SOYMON034 | g1890352 | BLASTN | 88 | 1e-28 | 63 |
| 2899 | -701068223 | 701068223H1 | SOYMON034 | g437326 | BLASTN | 636 | 1e-44 | 75 |
| 2900 | -701068964 | 701068964H1 | SOYMON034 | g1850792 | BLASTN | 496 | 1e-31 | 82 |
| 2901 | -701096947 | 701096947H1 | SOYMON028 | g945086 | BLASTN | 276 | 1e-52 | 91 |
| 2902 | -701098982 | 701098982H1 | SOYMON028 | g556557 | BLASTN | 435 | 1e-50 | 81 |
| 2903 | -701099463 | 701099463H1 | SOYMON028 | g662929 | BLASTN | 240 | 1e-09 | 86 |
| 2904 | -701099874 | 701099874H1 | SOYMON028 | g1763062 | BLASTN | 586 | 1e-67 | 98 |
| 2905 | -701100471 | 701100471H1 | SOYMON028 | g1763062 | BLASTN | 1176 | 1e-89 | 93 |
| 2906 | -701100647 | 701100647H1 | SOYMON028 | g1732513 | BLASTN | 136 | 1e-34 | 70 |
| 2907 | -701101675 | 701101675H1 | SOYMON028 | g1931638 | BLASTN | 224 | 1e-32 | 65 |
| 2908 | -701102484 | 701102484H1 | SOYMON028 | g662929 | BLASTN | 410 | 1e-61 | 87 |
| 2909 | -701102774 | 701102774H1 | SOYMON028 | g431907 | BLASTN | 489 | 1e-44 | 80 |
| 2910 | -701102848 | 701102848H1 | SOYMON028 | g19260 | BLASTN | 123 | 1e-18 | 59 |
| 2911 | -701102963 | 701102963H1 | SOYMON028 | g1899057 | BLASTN | 218 | 1e-18 | 67 |
| 2912 | -701103246 | 701103246H1 | SOYMON028 | g662929 | BLASTN | 286 | 1e-16 | 79 |
| 2913 | -701106671 | 701106671H1 | SOYMON036 | g214598 | BLASTN | 124 | 1e-19 | 46 |
| 2914 | -701106818 | 701106818H1 | SOYMON036 | g20562 | BLASTN | 517 | 1e-34 | 73 |
| 2915 | -701108616 | 701108616H1 | SOYMON036 | g431907 | BLASTN | 577 | 1e-39 | 79 |
| 2916 | -701109042 | 701109042H1 | SOYMON036 | g1430847 | BLASTN | 440 | 1e-26 | 83 |
| 2917 | -701117735 | 701117735H1 | SOYMON037 | g662929 | BLASTN | 778 | 1e-89 | 93 |
| 2918 | -701118607 | 701118607H1 | SOYMON037 | g2088641 | BLASTN | 251 | 1e-36 | 72 |
| 2919 | -701120037 | 701120037H1 | SOYMON037 | g1171428 | BLASTN | 489 | 1e-62 | 76 |
| 2920 | -701120442 | 701120442H1 | SOYMON037 | g330854 | BLASTN | 83 | 1e-17 | 41 |
| 2921 | -701121085 | 701121085H1 | SOYMON037 | g2832499 | BLASTN | 251 | 1e-12 | 76 |
| 2922 | -701121336 | 701121336H1 | SOYMON037 | g1763063 | BLASTN | 98 | 1e-18 | 65 |
| 2923 | -701122944 | 701122944H1 | SOYMON037 | g2088641 | BLASTN | 111 | 1e-33 | 66 |
| 2924 | -701123350 | 701123350H1 | SOYMON037 | g1841475 | BLASTN | 135 | 1e-20 | 58 |
| 2925 | -701123424 | 701123424H1 | SOYMON037 | g2564336 | BLASTN | 434 | 1e-29 | 78 |
| 2926 | -701124935 | 701124935H1 | SOYMON037 | g1171429 | BLASTN | 180 | 1e-42 | 84 |
| 2927 | -701129683 | 701129683H1 | SOYMON037 | g2145358 | BLASTN | 113 | 1e-19 | 76 |
| 2928 | -701129720 | 701129720H1 | SOYMON037 | g1747309 | BLASTN | 304 | 1e-33 | 85 |
| 2929 | -701130095 | 701130095H1 | SOYMON037 | g1666173 | BLASTN | 80 | 1e-21 | 94 |
| 2930 | -701130517 | 701130517H1 | SOYMON038 | g20563 | BLASTN | 105 | 1e-27 | 67 |
| 2931 | -701132039 | 701132039H1 | SOYMON038 | g1747309 | BLASTN | 706 | 1e-49 | 76 |
| 2932 | -701134320 | 701134320H1 | SOYMON038 | g1171428 | BLASTN | 735 | 1e-63 | 79 |
| 2933 | -701135088 | 701135088H1 | SOYMON038 | g2398527 | BLASTN | 109 | 1e-22 | 69 |
| 2934 | -701135953 | 701135953H1 | SOYMON038 | g1850792 | BLASTN | 354 | 1e-18 | 78 |
| 2935 | -701137327 | 701137327H1 | SOYMON038 | g603404 | BLASTN | 81 | 1e-19 | 62 |
| 2936 | -701137395 | 701137395H1 | SOYMON038 | g1171428 | BLASTN | 451 | 1e-49 | 78 |
| 2937 | -701138849 | 701138849H1 | SOYMON038 | g1514441 | BLASTN | 309 | 1e-30 | 76 |
| 2938 | -701138933 | 701138933H1 | SOYMON038 | g662931 | BLASTN | 475 | 1e-29 | 76 |

SOYBEAN OTHER TRANSCRIPTION FACTORS

-continued

| Seq No. | Cluster ID | CloneID | Library | NCBI gi | METHOD | Score | P-Value | % Ident |
|---|---|---|---|---|---|---|---|---|
| 2939 | -701139603 | 701139603H1 | SOYMON038 | g1171429 | BLASTN | 185 | 1e-27 | 82 |
| 2940 | -701140084 | 701140084H1 | SOYMON038 | g1171428 | BLASTN | 714 | 1e-50 | 78 |
| 2941 | -701147176 | 701147176H1 | SOYMON031 | g2463332 | BLASTN | 550 | 1e-37 | 75 |
| 2942 | -701148988 | 701148988H1 | SOYMON031 | g1928873 | BLASTN | 564 | 1e-38 | 83 |
| 2943 | -701150368 | 701150368H1 | SOYMON031 | g928927 | BLASTN | 549 | 1e-36 | 71 |
| 2944 | -701202962 | 701202962H1 | SOYMON035 | g1747309 | BLASTN | 391 | 1e-37 | 78 |
| 2945 | -701203226 | 701203226H1 | SOYMON035 | g20563 | BLASTN | 159 | 1e-45 | 94 |
| 2946 | -701205743 | 701205743H1 | SOYMON035 | g2245390 | BLASTN | 125 | 1e-23 | 69 |
| 2947 | -701206181 | 701206181H1 | SOYMON035 | g1429226 | BLASTN | 120 | 1e-18 | 66 |
| 2948 | -701210138 | 701210138H1 | SOYMON035 | g1109830 | BLASTN | 95 | 1e-18 | 49 |
| 2949 | -701211108 | 701211108H1 | SOYMON035 | g1666172 | BLASTN | 249 | 1e-26 | 70 |
| 2950 | -701211345 | 701211345H1 | SOYMON035 | g2196466 | BLASTN | 188 | 1e-35 | 71 |
| 2951 | -701212212 | 701212212H1 | SOYMON035 | g1181186 | BLASTN | 197 | 1e-29 | 57 |
| 2952 | -701214026 | 701214026H1 | SOYMON035 | g1430845 | BLASTN | 581 | 1e-39 | 73 |
| 2953 | -701214813 | 701214813H1 | SOYMON035 | g1046275 | BLASTN | 461 | 1e-28 | 79 |
| 2954 | -701214851 | 701214851H1 | SOYMON035 | g2832407 | BLASTN | 683 | 1e-48 | 76 |
| 2955 | 10000 | 700905921H1 | SOYMON022 | g1617210 | BLASTN | 258 | 1e-10 | 85 |
| 2956 | 10000 | 701003915H1 | SOYMON019 | g19382 | BLASTN | 148 | 1e-22 | 93 |
| 2957 | 10171 | 700905319H1 | SOYMON022 | g1046275 | BLASTN | 486 | 1e-31 | 84 |
| 2958 | 10171 | 700908163H1 | SOYMON022 | g1046275 | BLASTN | 424 | 1e-26 | 84 |
| 2959 | 10171 | 700986903H1 | SOYMON009 | g1046275 | BLASTN | 324 | 1e-31 | 84 |
| 2960 | 10254 | 700737791H1 | SOYMON012 | g2505876 | BLASTN | 237 | 1e-36 | 86 |
| 2961 | 10254 | 700873059H1 | SOYMON018 | g2505876 | BLASTN | 249 | 1e-38 | 90 |
| 2962 | 10254 | 700874972H1 | SOYMON018 | g2505876 | BLASTN | 179 | 1e-27 | 88 |
| 2963 | 10254 | 700985967H1 | SOYMON009 | g2505876 | BLASTN | 194 | 1e-41 | 86 |
| 2964 | 10437 | 700840793H1 | SOYMON020 | g290056 | BLASTN | 573 | 1e-38 | 70 |
| 2965 | 10437 | 700895915H1 | SOYMON027 | g290056 | BLASTN | 458 | 1e-29 | 71 |
| 2966 | 10437 | 700982926H1 | SOYMON009 | g290056 | BLASTN | 627 | 1e-43 | 70 |
| 2967 | 10437 | 701060360H1 | SOYMON033 | g290056 | BLASTN | 688 | 1e-48 | 72 |
| 2968 | 10437 | 701131592H1 | SOYMON038 | g290056 | BLASTN | 410 | 1e-39 | 74 |
| 2969 | 10437 | 701144641H1 | SOYMON031 | g290056 | BLASTN | 585 | 1e-39 | 71 |
| 2970 | 10565 | 700991425H1 | SOYMON011 | g2702280 | BLASTN | 179 | 1e-26 | 62 |
| 2971 | 10565 | 701108083H1 | SOYMON036 | g2702280 | BLASTN | 151 | 1e-28 | 58 |
| 2972 | 10787 | 700719912H1 | SOYMON006 | g945086 | BLASTN | 559 | 1e-47 | 92 |
| 2973 | 10787 | 700758466H1 | SOYMON015 | g945086 | BLASTN | 876 | 1e-64 | 93 |
| 2974 | 10787 | 700892117H1 | SOYMON024 | g945086 | BLASTN | 443 | 1e-42 | 91 |
| 2975 | 10787 | 700896444H1 | SOYMON027 | g945086 | BLASTN | 947 | 1e-70 | 93 |
| 2976 | 10787 | 700949946H1 | SOYMON024 | g945086 | BLASTN | 899 | 1e-66 | 92 |
| 2977 | 10787 | 701210005H1 | SOYMON035 | g945086 | BLASTN | 774 | 1e-74 | 89 |
| 2978 | 10787 | LIB3051-069-Q1-K1-A2 | LIB3051 | g945086 | BLASTN | 839 | 1e-78 | 88 |
| 2979 | 10864 | 700749919H1 | SOYMON013 | g662929 | BLASTN | 880 | 1e-64 | 83 |
| 2980 | 10864 | 700842507H1 | SOYMON020 | g662929 | BLASTN | 1050 | 1e-78 | 91 |
| 2981 | 10946 | 700654986H1 | SOYMON004 | g2104680 | BLASTN | 879 | 1e-64 | 81 |
| 2982 | 10946 | 700681111H2 | SOYMON008 | g2104680 | BLASTN | 430 | 1e-46 | 76 |
| 2983 | 1095 | 700748161H1 | SOYMON013 | g1370139 | BLASTN | 431 | 1e-25 | 78 |
| 2984 | 1095 | 700794538H1 | SOYMON017 | g1370139 | BLASTN | 444 | 1e-26 | 79 |
| 2985 | 1095 | 700868407H1 | SOYMON016 | g1370139 | BLASTN | 428 | 1e-25 | 76 |
| 2986 | 1095 | 700953788H1 | SOYMON022 | g20561 | BLASTN | 210 | 1e-31 | 85 |
| 2987 | 1095 | 700986049H1 | SOYMON009 | g1732247 | BLASTN | 158 | 1e-23 | 82 |
| 2988 | 1095 | 701051568H1 | SOYMON032 | g20560 | BLASTN | 514 | 1e-34 | 79 |
| 2989 | 1095 | 701123405H1 | SOYMON037 | g20560 | BLASTN | 509 | 1e-33 | 75 |
| 2990 | 1095 | 701123928H1 | SOYMON037 | g20560 | BLASTN | 611 | 1e-42 | 80 |
| 2991 | 1095 | 701146219H1 | SOYMON031 | g20561 | BLASTN | 132 | 1e-20 | 76 |
| 2992 | 1095 | LIB3050-013-Q1-E1-B11 | LIB3050 | g20560 | BLASTN | 698 | 1e-47 | 77 |
| 2993 | 1095 | LIB3050-026-Q1-K1-H10 | LIB3050 | g20560 | BLASTN | 835 | 1e-60 | 79 |
| 2994 | 1095 | LIB3051-115-Q1-K1-C4 | LIB3051 | g20560 | BLASTN | 698 | 1e-48 | 79 |
| 2995 | 11055 | 700759318H1 | SOYMON015 | g19260 | BLASTN | 199 | 1e-29 | 88 |
| 2996 | 11055 | 701057861H1 | SOYMON033 | g19260 | BLASTN | 193 | 1e-28 | 85 |
| 2997 | 11147 | 700654617H1 | SOYMON004 | g2062176 | BLASTN | 108 | 1e-18 | 71 |
| 2998 | 11147 | 700895996H1 | SOYMON027 | g2062176 | BLASTN | 113 | 1e-19 | 81 |
| 2999 | 11250 | 700661815H1 | SOYMON005 | g386005 | BLASTN | 178 | 1e-33 | 57 |
| 3000 | 11328 | LIB3051-115-Q1-K1-G1 | LIB3051 | g3183616 | BLASTN | 495 | 1e-30 | 73 |
| 3001 | 11544 | 700654919H1 | SOYMON004 | g786426 | BLASTN | 196 | 1e-29 | 62 |
| 3002 | 11544 | 700676985H1 | SOYMON007 | g786426 | BLASTN | 120 | 1e-23 | 67 |
| 3003 | 11544 | 700679185H1 | SOYMON007 | g786426 | BLASTN | 103 | 1e-26 | 73 |
| 3004 | 11544 | 700990491H1 | SOYMON011 | g786426 | BLASTN | 171 | 1e-28 | 74 |
| 3005 | 11544 | 701139368H1 | SOYMON038 | g786425 | BLASTN | 246 | 1e-09 | 66 |
| 3006 | 11544 | LIB3051-101-Q1-K1-G3 | LIB3051 | g786425 | BLASTN | 415 | 1e-30 | 73 |

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3007 | 11644 | 700671391H1 | SOYMON006 | g2464855 | BLASTN | 166 | 1e-25 | 77 |
| 3008 | 11644 | 700747110H1 | SOYMON013 | g217859 | BLASTN | 97 | 1e-22 | 70 |
| 3009 | 11644 | 700845340H1 | SOYMON021 | g2464855 | BLASTN | 120 | 1e-27 | 80 |
| 3010 | 11644 | 700957305H1 | SOYMON022 | g2464855 | BLASTN | 172 | 1e-25 | 76 |
| 3011 | 11644 | 701003021H1 | SOYMON019 | g2464855 | BLASTN | 172 | 1e-25 | 78 |
| 3012 | 11644 | 701127520H1 | SOYMON037 | g2464855 | BLASTN | 275 | 1e-40 | 85 |
| 3013 | 11644 | 701203752H2 | SOYMON035 | g2464855 | BLASTN | 133 | 1e-20 | 75 |
| 3014 | 11667 | 700653218H1 | SOYMON003 | g2505876 | BLASTN | 129 | 1e-21 | 73 |
| 3015 | 11667 | 700750602H1 | SOYMON014 | g2191140 | BLASTN | 131 | 1e-25 | 77 |
| 3016 | 11751 | 700942949H1 | SOYMON024 | g2398533 | BLASTN | 139 | 1e-21 | 90 |
| 3017 | 11851 | 700755115H1 | SOYMON014 | g945086 | BLASTN | 745 | 1e-53 | 100 |
| 3018 | 11851 | 701069677H1 | SOYMON034 | g945086 | BLASTN | 803 | 1e-58 | 97 |
| 3019 | 11851 | 701136069H1 | SOYMON038 | g945086 | BLASTN | 463 | 1e-56 | 94 |
| 3020 | 11900 | 700566352H1 | SOYMON002 | g862650 | BLASTN | 120 | 1e-21 | 94 |
| 3021 | 11900 | 700747814H1 | SOYMON013 | g862650 | BLASTN | 168 | 1e-25 | 94 |
| 3022 | 11955 | 700557413H1 | SOYMON001 | g1666172 | BLASTN | 851 | 1e-67 | 82 |
| 3023 | 11955 | 700663253H1 | SOYMON005 | g1666172 | BLASTN | 428 | 1e-26 | 79 |
| 3024 | 11955 | 700794214H1 | SOYMON017 | g1666172 | BLASTN | 755 | 1e-54 | 82 |
| 3025 | 11955 | 700830566H1 | SOYMON019 | g1666173 | BLASTN | 183 | 1e-39 | 71 |
| 3026 | 11955 | 700944006H1 | SOYMON024 | g1666172 | BLASTN | 650 | 1e-45 | 81 |
| 3027 | 11955 | 701004958H1 | SOYMON019 | g1666172 | BLASTN | 570 | 1e-42 | 82 |
| 3028 | 11955 | 701005066H1 | SOYMON019 | g1666172 | BLASTN | 726 | 1e-51 | 80 |
| 3029 | 11955 | 701069066H1 | SOYMON034 | g1666172 | BLASTN | 593 | 1e-53 | 81 |
| 3030 | 11955 | 701131007H1 | SOYMON038 | g1666172 | BLASTN | 863 | 1e-63 | 82 |
| 3031 | 11955 | LIB3049-032-Q1-E1-D10 | LIB3049 | g1666172 | BLASTN | 451 | 1e-38 | 76 |
| 3032 | 12048 | 700566792H1 | SOYMON002 | g1946267 | BLASTN | 123 | 1e-34 | 62 |
| 3033 | 12048 | 700568511H1 | SOYMON002 | g1514441 | BLASTN | 452 | 1e-27 | 65 |
| 3034 | 12048 | 700831304H1 | SOYMON019 | g1946267 | BLASTN | 233 | 1e-34 | 65 |
| 3035 | 12048 | 700869181H1 | SOYMON016 | g1946267 | BLASTN | 131 | 1e-20 | 56 |
| 3036 | 12091 | 700845953H1 | SOYMON021 | g2145358 | BLASTN | 167 | 1e-24 | 67 |
| 3037 | 1230 | 700684237H1 | SOYMON008 | g2398523 | BLASTN | 126 | 1e-22 | 86 |
| 3038 | 1230 | 700844895H1 | SOYMON021 | g2398523 | BLASTN | 133 | 1e-20 | 85 |
| 3039 | 1236 | LIB3051-020-Q1-E1-G2 | LIB3051 | g2398533 | BLASTN | 122 | 1e-34 | 85 |
| 3040 | 12388 | 700646372H1 | SOYMON013 | g662929 | BLASTN | 593 | 1e-47 | 85 |
| 3041 | 12388 | 701038095H1 | SOYMON029 | g662929 | BLASTN | 447 | 1e-43 | 78 |
| 3042 | 12388 | 701100361H1 | SOYMON028 | g662929 | BLASTN | 569 | 1e-45 | 89 |
| 3043 | 12388 | 701122795H1 | SOYMON037 | g662929 | BLASTN | 656 | 1e-58 | 89 |
| 3044 | 12498 | 700979878H2 | SOYMON009 | g662927 | BLASTN | 521 | 1e-34 | 99 |
| 3045 | 12498 | 701001033H1 | SOYMON018 | g662931 | BLASTN | 496 | 1e-31 | 74 |
| 3046 | 12498 | 701104992H1 | SOYMON036 | g2464881 | BLASTN | 155 | 1e-28 | 68 |
| 3047 | 12498 | LIB3027-001-Q1-B1-H8 | LIB3027 | g2464881 | BLASTN | 151 | 1e-37 | 67 |
| 3048 | 12498 | LIB3027-009-Q1-B1-B6 | LIB3027 | g1619921 | BLASTN | 167 | 1e-48 | 66 |
| 3049 | 12799 | 700956693H1 | SOYMON022 | g2145358 | BLASTN | 167 | 1e-33 | 73 |
| 3050 | 12804 | 700833812H1 | SOYMON019 | g662929 | BLASTN | 335 | 1e-17 | 84 |
| 3051 | 12804 | 700956487H1 | SOYMON022 | g662929 | BLASTN | 236 | 1e-09 | 84 |
| 3052 | 12804 | 701008918H1 | SOYMON019 | g662929 | BLASTN | 326 | 1e-16 | 82 |
| 3053 | 1281 | 701120916H1 | SOYMON037 | g1763063 | BLASTN | 71 | 1e-22 | 82 |
| 3054 | 13017 | 700972418H1 | SOYMON005 | g2505876 | BLASTN | 95 | 1e-19 | 68 |
| 3055 | 13126 | 700895010H1 | SOYMON024 | g662929 | BLASTN | 325 | 1e-16 | 83 |
| 3056 | 13126 | 701010473H1 | SOYMON019 | g662929 | BLASTN | 325 | 1e-16 | 83 |
| 3057 | 13126 | 701061469H1 | SOYMON033 | g662929 | BLASTN | 318 | 1e-15 | 82 |
| 3058 | 13165 | 700842617H1 | SOYMON020 | g671867 | BLASTN | 139 | 1e-28 | 83 |
| 3059 | 13165 | 700843378H1 | SOYMON020 | g671867 | BLASTN | 129 | 1e-19 | 73 |
| 3060 | 13389 | 700854414H1 | SOYMON023 | g1747310 | BLASTN | 202 | 1e-29 | 60 |
| 3061 | 13389 | 700959877H1 | SOYMON022 | g1747310 | BLASTN | 214 | 1e-30 | 51 |
| 3062 | 13392 | 700743260H1 | SOYMON012 | g1167484 | BLASTN | 148 | 1e-22 | 67 |
| 3063 | 13392 | 700831149H1 | SOYMON019 | g19050 | BLASTN | 722 | 1e-51 | 80 |
| 3064 | 13392 | 700835414H1 | SOYMON019 | g19050 | BLASTN | 704 | 1e-49 | 81 |
| 3065 | 13392 | 700851767H1 | SOYMON023 | g1167483 | BLASTN | 520 | 1e-34 | 83 |
| 3066 | 13392 | 700945055H1 | SOYMON024 | g1167483 | BLASTN | 445 | 1e-36 | 81 |
| 3067 | 13392 | 701055965H1 | SOYMON032 | g1167483 | BLASTN | 675 | 1e-53 | 80 |
| 3068 | 13392 | 701145654H1 | SOYMON031 | g1167483 | BLASTN | 534 | 1e-35 | 84 |
| 3069 | 13392 | 701151737H1 | SOYMON031 | g19050 | BLASTN | 810 | 1e-58 | 81 |
| 3070 | 13392 | 701156351H1 | SOYMON031 | g1167484 | BLASTN | 127 | 1e-24 | 86 |
| 3071 | 13392 | 701206635H1 | SOYMON035 | g19050 | BLASTN | 865 | 1e-63 | 82 |
| 3072 | 13392 | 701207519H1 | SOYMON035 | g1167483 | BLASTN | 525 | 1e-34 | 81 |
| 3073 | 13392 | 701211201H1 | SOYMON035 | g1167483 | BLASTN | 627 | 1e-43 | 73 |
| 3074 | 13392 | LIB3028-011-Q1-B1-B6 | LIB3028 | g19050 | BLASTN | 933 | 1e-87 | 80 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3075 | 13392 | LIB3028-012-Q1-B1-D11 | LIB3028 | g19050 | BLASTN | 933 | 1e−83 | 80 |
| 3076 | 13447 | 700904560H1 | SOYMON022 | g2459835 | BLASTN | 83 | 1e−19 | 83 |
| 3077 | 13566 | 700554165H1 | SOYMON001 | g1899058 | BLASTN | 142 | 1e−21 | 69 |
| 3078 | 13566 | 700557146H1 | SOYMON001 | g1899058 | BLASTN | 128 | 1e−19 | 62 |
| 3079 | 13566 | 700754291H1 | SOYMON014 | g1899058 | BLASTN | 162 | 1e−24 | 65 |
| 3080 | 13796 | 700653244H1 | SOYMON003 | g2642435 | BLASTN | 268 | 1e−39 | 88 |
| 3081 | 13796 | 700835762H1 | SOYMON019 | g2464855 | BLASTN | 250 | 1e−59 | 86 |
| 3082 | 13796 | 700863608H1 | SOYMON027 | g2642435 | BLASTN | 255 | 1e−37 | 86 |
| 3083 | 13796 | 700895370H1 | SOYMON027 | g1263094 | BLASTN | 462 | 1e−28 | 70 |
| 3084 | 13796 | 700958710H1 | SOYMON022 | g2464855 | BLASTN | 174 | 1e−26 | 78 |
| 3085 | 13796 | 700978574H1 | SOYMON009 | g2642435 | BLASTN | 233 | 1e−34 | 87 |
| 3086 | 13796 | 701097113H1 | SOYMON028 | g2642435 | BLASTN | 253 | 1e−37 | 88 |
| 3087 | 13796 | 701120572H1 | SOYMON037 | g2642435 | BLASTN | 119 | 1e−18 | 79 |
| 3088 | 13823 | 700835395H1 | SOYMON019 | g1747309 | BLASTN | 268 | 1e−11 | 88 |
| 3089 | 13823 | 700900510H1 | SOYMON027 | g1747310 | BLASTN | 140 | 1e−21 | 100 |
| 3090 | 13927 | 701043135H1 | SOYMON029 | g1049022 | BLASTN | 123 | 1e−19 | 86 |
| 3091 | 14042 | 700954715H1 | SOYMON022 | g2088643 | BLASTN | 186 | 1e−28 | 66 |
| 3092 | 14042 | 700958105H1 | SOYMON022 | g2088643 | BLASTN | 186 | 1e−28 | 66 |
| 3093 | 1426 | 700677935H1 | SOYMON007 | g1239962 | BLASTN | 771 | 1e−55 | 88 |
| 3094 | 1426 | 700964919H1 | SOYMON022 | g1239958 | BLASTN | 919 | 1e−67 | 87 |
| 3095 | 1426 | 700967431H1 | SOYMON031 | g1239962 | BLASTN | 673 | 1e−47 | 87 |
| 3096 | 1426 | 700978693H1 | SOYMON009 | g1239958 | BLASTN | 863 | 1e−63 | 86 |
| 3097 | 1426 | 701204748H1 | SOYMON035 | g1239962 | BLASTN | 671 | 1e−47 | 88 |
| 3098 | 1426 | 701207929H1 | SOYMON035 | g1239962 | BLASTN | 789 | 1e−57 | 92 |
| 3099 | 1426 | 701212036H1 | SOYMON035 | g1239958 | BLASTN | 849 | 1e−62 | 88 |
| 3100 | 1426 | 701212768H1 | SOYMON035 | g1239962 | BLASTN | 537 | 1e−46 | 88 |
| 3101 | 1426 | 701212925H1 | SOYMON035 | g1239958 | BLASTN | 918 | 1e−67 | 86 |
| 3102 | 1426 | 701214971H1 | SOYMON035 | g1239962 | BLASTN | 847 | 1e−61 | 89 |
| 3103 | 1426 | LIB3049-043-Q1-E1-A1 | LIB3049 | g3184053 | BLASTN | 641 | 1e−67 | 82 |
| 3104 | 1426 | LIB3049-045-Q1-E1-A2 | LIB3049 | g1239958 | BLASTN | 1058 | 1e−79 | 77 |
| 3105 | 14645 | 700792802H1 | SOYMON017 | g2464855 | BLASTN | 247 | 1e−41 | 83 |
| 3106 | 14645 | 700953094H1 | SOYMON022 | g1263095 | BLASTN | 130 | 1e−22 | 86 |
| 3107 | 14752 | 700676408H1 | SOYMON007 | g2398529 | BLASTN | 229 | 1e−35 | 67 |
| 3108 | 14752 | 700678883H1 | SOYMON007 | g2398527 | BLASTN | 192 | 1e−30 | 64 |
| 3109 | 14752 | LIB3040-002-Q1-E1-H9 | LIB3040 | g2244810 | BLASTN | 186 | 1e−47 | 67 |
| 3110 | 14752 | LIB3040-043-Q1-E1-A2 | LIB3040 | g2398529 | BLASTN | 145 | 1e−49 | 58 |
| 3111 | 15006 | 700556101H1 | SOYMON001 | g1905943 | BLASTN | 502 | 1e−32 | 74 |
| 3112 | 15006 | 700756565H1 | SOYMON014 | g1905943 | BLASTN | 486 | 1e−30 | 73 |
| 3113 | 15006 | 701152347H1 | SOYMON031 | g886401 | BLASTN | 176 | 1e−30 | 68 |
| 3114 | 15006 | 701213371H1 | SOYMON035 | g2286108 | BLASTN | 415 | 1e−24 | 74 |
| 3115 | 15121 | 701151729H1 | SOYMON031 | g1850792 | BLASTN | 317 | 1e−15 | 76 |
| 3116 | 15282 | 700554959H1 | SOYMON001 | g662929 | BLASTN | 736 | 1e−92 | 90 |
| 3117 | 15282 | 700565494H1 | SOYMON002 | g662929 | BLASTN | 653 | 1e−48 | 97 |
| 3118 | 15282 | 700672958H1 | SOYMON006 | g662929 | BLASTN | 1138 | 1e−86 | 92 |
| 3119 | 15282 | 700841765H1 | SOYMON020 | g662929 | BLASTN | 1158 | 1e−87 | 98 |
| 3120 | 15282 | 700865782H1 | SOYMON016 | g662929 | BLASTN | 812 | 1e−58 | 91 |
| 3121 | 15282 | 701005796H1 | SOYMON019 | g662929 | BLASTN | 970 | 1e−87 | 94 |
| 3122 | 15282 | 701011751H1 | SOYMON019 | g662929 | BLASTN | 955 | 1e−84 | 96 |
| 3123 | 15282 | 701040773H1 | SOYMON029 | g662929 | BLASTN | 506 | 1e−53 | 95 |
| 3124 | 15282 | 701043485H1 | SOYMON029 | g662929 | BLASTN | 591 | 1e−84 | 93 |
| 3125 | 15282 | 701099256H1 | SOYMON028 | g662929 | BLASTN | 808 | 1e−58 | 90 |
| 3126 | 15282 | 701102707H1 | SOYMON028 | g662929 | BLASTN | 814 | 1e−81 | 92 |
| 3127 | 15282 | 701104821H1 | SOYMON036 | g662929 | BLASTN | 706 | 1e−52 | 73 |
| 3128 | 1529 | 700838292H1 | SOYMON020 | g1747310 | BLASTN | 188 | 1e−46 | 79 |
| 3129 | 15300 | 701099385H1 | SOYMON028 | g1732246 | BLASTN | 314 | 1e−15 | 81 |
| 3130 | 15300 | 701100720H1 | SOYMON028 | g20560 | BLASTN | 757 | 1e−54 | 77 |
| 3131 | 15300 | 701102079H1 | SOYMON028 | g1732246 | BLASTN | 552 | 1e−37 | 76 |
| 3132 | 15300 | 701102311H1 | SOYMON028 | g1732246 | BLASTN | 599 | 1e−41 | 81 |
| 3133 | 15300 | LIB3050-017-Q1-E1-G2 | LIB3050 | g928967 | BLASTN | 190 | 1e−66 | 69 |
| 3134 | 15495 | 700675677H1 | SOYMON007 | g290054 | BLASTN | 499 | 1e−32 | 69 |
| 3135 | 15495 | 700973788H1 | SOYMON005 | g290054 | BLASTN | 568 | 1e−38 | 75 |
| 3136 | 15578 | 700564773H1 | SOYMON002 | g2832407 | BLASTN | 709 | 1e−50 | 78 |
| 3137 | 15578 | 700847403H1 | SOYMON021 | g2832408 | BLASTN | 162 | 1e−23 | 93 |
| 3138 | 15578 | 701063288H1 | SOYMON033 | g2832407 | BLASTN | 729 | 1e−52 | 80 |
| 3139 | 15587 | 700896212H1 | SOYMON027 | g1763063 | BLASTN | 104 | 1e−22 | 65 |
| 3140 | 15587 | 701005929H1 | SOYMON019 | g1763063 | BLASTN | 95 | 1e−19 | 60 |
| 3141 | 15621 | 700738572H1 | SOYMON012 | g556557 | BLASTN | 781 | 1e−56 | 80 |
| 3142 | 15621 | 700748295H1 | SOYMON013 | g556557 | BLASTN | 749 | 1e−53 | 76 |

SOYBEAN OTHER TRANSCRIPTION FACTORS

-continued

| Seq No. | Cluster ID | CloneID | Library | NCBI gi | METHOD | Score | P-Value | % Ident |
|---|---|---|---|---|---|---|---|---|
| 3143 | 15621 | 700786689H1 | SOYMON011 | g556557 | BLASTN | 762 | 1e−54 | 78 |
| 3144 | 15621 | 700847602H1 | SOYMON021 | g556557 | BLASTN | 788 | 1e−56 | 80 |
| 3145 | 15621 | 700982068H1 | SOYMON009 | g556557 | BLASTN | 434 | 1e−38 | 70 |
| 3146 | 15621 | 701141959H1 | SOYMON038 | g556557 | BLASTN | 270 | 1e−38 | 76 |
| 3147 | 15621 | 701211323H1 | SOYMON035 | g556557 | BLASTN | 822 | 1e−59 | 80 |
| 3148 | 15621 | LIB3051-041-Q1-K1-E7 | LIB3051 | g556557 | BLASTN | 1130 | 1e−85 | 75 |
| 3149 | 15621 | LIB3051-050-Q1-K1-C1 | LIB3051 | g556557 | BLASTN | 1051 | 1e−87 | 71 |
| 3150 | 15636 | 700908666H1 | SOYMON022 | g786425 | BLASTN | 321 | 1e−16 | 74 |
| 3151 | 15636 | 701214806H1 | SOYMON035 | g786426 | BLASTN | 141 | 1e−21 | 65 |
| 3152 | 15750 | 701100857H1 | SOYMON028 | g1429226 | BLASTN | 123 | 1e−19 | 75 |
| 3153 | 15784 | 700977108H1 | SOYMON009 | g1430846 | BLASTN | 134 | 1e−26 | 76 |
| 3154 | 15814 | 700876181H1 | SOYMON018 | g1430845 | BLASTN | 379 | 1e−30 | 84 |
| 3155 | 15814 | 700904208H1 | SOYMON022 | g1430845 | BLASTN | 520 | 1e−34 | 85 |
| 3156 | 15949 | 701013357H1 | SOYMON019 | g2832499 | BLASTN | 281 | 1e−14 | 86 |
| 3157 | 16 | 700653362H1 | SOYMON004 | g1666172 | BLASTN | 562 | 1e−45 | 79 |
| 3158 | 16 | 700657269H1 | SOYMON004 | g1666172 | BLASTN | 714 | 1e−50 | 74 |
| 3159 | 16 | 700662937H1 | SOYMON005 | g1666172 | BLASTN | 807 | 1e−58 | 81 |
| 3160 | 16 | 700663027H1 | SOYMON005 | g1666172 | BLASTN | 860 | 1e−63 | 83 |
| 3161 | 16 | 700664156H1 | SOYMON005 | g1666172 | BLASTN | 681 | 1e−48 | 81 |
| 3162 | 16 | 700676039H1 | SOYMON007 | g862639 | BLASTN | 719 | 1e−51 | 84 |
| 3163 | 16 | 700678604H1 | SOYMON007 | g1666172 | BLASTN | 702 | 1e−61 | 80 |
| 3164 | 16 | 700725871H1 | SOYMON009 | g1666172 | BLASTN | 271 | 1e−11 | 78 |
| 3165 | 16 | 700727454H1 | SOYMON009 | g1666172 | BLASTN | 696 | 1e−49 | 82 |
| 3166 | 16 | 700736278H1 | SOYMON010 | g1666172 | BLASTN | 478 | 1e−31 | 82 |
| 3167 | 16 | 700736391H1 | SOYMON010 | g1666172 | BLASTN | 730 | 1e−52 | 83 |
| 3168 | 16 | 700745252H1 | SOYMON013 | g1666172 | BLASTN | 623 | 1e−43 | 76 |
| 3169 | 16 | 700751351H1 | SOYMON014 | g1666172 | BLASTN | 763 | 1e−55 | 82 |
| 3170 | 16 | 700751364H1 | SOYMON014 | g1666172 | BLASTN | 793 | 1e−57 | 83 |
| 3171 | 16 | 700756018H1 | SOYMON014 | g1666172 | BLASTN | 834 | 1e−61 | 83 |
| 3172 | 16 | 700757875H1 | SOYMON015 | g1666172 | BLASTN | 702 | 1e−57 | 80 |
| 3173 | 16 | 700761204H1 | SOYMON015 | g1666172 | BLASTN | 481 | 1e−44 | 82 |
| 3174 | 16 | 700786192H2 | SOYMON011 | g1666172 | BLASTN | 763 | 1e−55 | 82 |
| 3175 | 16 | 700790278H2 | SOYMON011 | g1666172 | BLASTN | 759 | 1e−54 | 84 |
| 3176 | 16 | 700830133H1 | SOYMON019 | g1666172 | BLASTN | 811 | 1e−59 | 82 |
| 3177 | 16 | 700834579H1 | SOYMON019 | g1666172 | BLASTN | 714 | 1e−50 | 83 |
| 3178 | 16 | 700835286H1 | SOYMON019 | g1666172 | BLASTN | 743 | 1e−53 | 84 |
| 3179 | 16 | 700835341H1 | SOYMON019 | g1666172 | BLASTN | 702 | 1e−49 | 83 |
| 3180 | 16 | 700837153H1 | SOYMON020 | g1666172 | BLASTN | 714 | 1e−50 | 83 |
| 3181 | 16 | 700841675H1 | SOYMON020 | g1666172 | BLASTN | 747 | 1e−53 | 84 |
| 3182 | 16 | 700841893H1 | SOYMON020 | g1666172 | BLASTN | 611 | 1e−42 | 82 |
| 3183 | 16 | 700845174H1 | SOYMON021 | g1666172 | BLASTN | 702 | 1e−49 | 83 |
| 3184 | 16 | 700845538H1 | SOYMON021 | g1666172 | BLASTN | 402 | 1e−54 | 81 |
| 3185 | 16 | 700850610H1 | SOYMON023 | g1666172 | BLASTN | 714 | 1e−50 | 83 |
| 3186 | 16 | 700852474H1 | SOYMON023 | g1666172 | BLASTN | 702 | 1e−49 | 83 |
| 3187 | 16 | 700856326H1 | SOYMON023 | g1666172 | BLASTN | 377 | 1e−45 | 81 |
| 3188 | 16 | 700888743H1 | SOYMON024 | g1666172 | BLASTN | 269 | 1e−31 | 74 |
| 3189 | 16 | 700893155H1 | SOYMON024 | g1666172 | BLASTN | 586 | 1e−47 | 79 |
| 3190 | 16 | 700898574H1 | SOYMON027 | g1666172 | BLASTN | 702 | 1e−49 | 79 |
| 3191 | 16 | 700901515H1 | SOYMON027 | g1666172 | BLASTN | 702 | 1e−54 | 80 |
| 3192 | 16 | 700942619H1 | SOYMON024 | g1666172 | BLASTN | 695 | 1e−58 | 79 |
| 3193 | 16 | 700963930H1 | SOYMON022 | g1666172 | BLASTN | 834 | 1e−61 | 83 |
| 3194 | 16 | 700967576H1 | SOYMON032 | g1666172 | BLASTN | 614 | 1e−42 | 82 |
| 3195 | 16 | 700968115H1 | SOYMON035 | g862640 | BLASTN | 163 | 1e−24 | 74 |
| 3196 | 16 | 700969563H1 | SOYMON005 | g1666172 | BLASTN | 689 | 1e−48 | 83 |
| 3197 | 16 | 700971156H1 | SOYMON005 | g1666172 | BLASTN | 702 | 1e−59 | 80 |
| 3198 | 16 | 700971170H1 | SOYMON005 | g1666172 | BLASTN | 702 | 1e−59 | 80 |
| 3199 | 16 | 700976536H1 | SOYMON009 | g1666172 | BLASTN | 260 | 1e−12 | 70 |
| 3200 | 16 | 700980472H1 | SOYMON009 | g602900 | BLASTN | 190 | 1e−31 | 92 |
| 3201 | 16 | 700985866H1 | SOYMON009 | g1666172 | BLASTN | 856 | 1e−62 | 81 |
| 3202 | 16 | 701003617H1 | SOYMON019 | g1666172 | BLASTN | 713 | 1e−56 | 80 |
| 3203 | 16 | 701038358H1 | SOYMON029 | g1666172 | BLASTN | 352 | 1e−20 | 83 |
| 3204 | 16 | 701043959H1 | SOYMON032 | g1666172 | BLASTN | 689 | 1e−51 | 80 |
| 3205 | 16 | 701045034H1 | SOYMON032 | g1666172 | BLASTN | 471 | 1e−30 | 82 |
| 3206 | 16 | 701045576H1 | SOYMON032 | g1666172 | BLASTN | 637 | 1e−44 | 82 |
| 3207 | 16 | 701047631H1 | SOYMON032 | g1666172 | BLASTN | 501 | 1e−33 | 82 |
| 3208 | 16 | 701049091H1 | SOYMON032 | g1666172 | BLASTN | 613 | 1e−42 | 83 |
| 3209 | 16 | 701050828H1 | SOYMON032 | g1666172 | BLASTN | 252 | 1e−12 | 83 |
| 3210 | 16 | 701051857H1 | SOYMON032 | g1666172 | BLASTN | 529 | 1e−35 | 83 |
| 3211 | 16 | 701052545H1 | SOYMON032 | g1666172 | BLASTN | 282 | 1e−41 | 82 |
| 3212 | 16 | 701053715H1 | SOYMON032 | g1666172 | BLASTN | 211 | 1e−12 | 86 |
| 3213 | 16 | 701053914H1 | SOYMON032 | g1666172 | BLASTN | 728 | 1e−52 | 85 |
| 3214 | 16 | 701055752H1 | SOYMON032 | g1666172 | BLASTN | 714 | 1e−50 | 83 |

SOYBEAN OTHER TRANSCRIPTION FACTORS

-continued

| Seq No. | Cluster ID | CloneID | Library | NCBI gi | METHOD | Score | P-Value | % Ident |
|---|---|---|---|---|---|---|---|---|
| 3215 | 16 | 701055947H1 | SOYMON032 | g1666172 | BLASTN | 650 | 1e−51 | 81 |
| 3216 | 16 | 701059618H1 | SOYMON033 | g1666172 | BLASTN | 539 | 1e−55 | 82 |
| 3217 | 16 | 701061121H1 | SOYMON033 | g1666172 | BLASTN | 693 | 1e−49 | 81 |
| 3218 | 16 | 701067796H1 | SOYMON034 | g1666172 | BLASTN | 378 | 1e−22 | 83 |
| 3219 | 16 | 701068193H1 | SOYMON034 | g1666172 | BLASTN | 561 | 1e−47 | 80 |
| 3220 | 16 | 701068492H1 | SOYMON034 | g1666172 | BLASTN | 871 | 1e−64 | 83 |
| 3221 | 16 | 701069694H1 | SOYMON034 | g1666172 | BLASTN | 716 | 1e−51 | 83 |
| 3222 | 16 | 701103320H1 | SOYMON028 | g1666172 | BLASTN | 631 | 1e−43 | 82 |
| 3223 | 16 | 701120737H1 | SOYMON037 | g1666172 | BLASTN | 927 | 1e−68 | 83 |
| 3224 | 16 | 701129339H1 | SOYMON037 | g1666172 | BLASTN | 814 | 1e−59 | 82 |
| 3225 | 16 | 701133045H1 | SOYMON038 | g1666172 | BLASTN | 876 | 1e−64 | 83 |
| 3226 | 16 | 701138103H1 | SOYMON038 | g1666172 | BLASTN | 866 | 1e−63 | 81 |
| 3227 | 16 | 701143072H1 | SOYMON038 | g1666172 | BLASTN | 716 | 1e−51 | 83 |
| 3228 | 16 | 701204303H2 | SOYMON035 | g862639 | BLASTN | 737 | 1e−52 | 84 |
| 3229 | 16 | 701204608H1 | SOYMON035 | g1666172 | BLASTN | 702 | 1e−56 | 79 |
| 3230 | 16 | 701204922H1 | SOYMON035 | g862639 | BLASTN | 875 | 1e−64 | 79 |
| 3231 | 16 | 701205428H1 | SOYMON035 | g862639 | BLASTN | 650 | 1e−51 | 85 |
| 3232 | 16 | 701206347H1 | SOYMON035 | g1666172 | BLASTN | 927 | 1e−68 | 83 |
| 3233 | 16 | 701207820H1 | SOYMON035 | g862639 | BLASTN | 579 | 1e−39 | 81 |
| 3234 | 16 | 701209725H1 | SOYMON035 | g1666172 | BLASTN | 702 | 1e−61 | 80 |
| 3235 | 16 | 701209945H1 | SOYMON035 | g862639 | BLASTN | 495 | 1e−32 | 77 |
| 3236 | 16 | 701210002H1 | SOYMON035 | g1666172 | BLASTN | 670 | 1e−47 | 80 |
| 3237 | 16 | 701211050H1 | SOYMON035 | g862639 | BLASTN | 716 | 1e−50 | 84 |
| 3238 | 16 | 701211278H1 | SOYMON035 | g1666172 | BLASTN | 471 | 1e−30 | 82 |
| 3239 | 16 | 701214222H1 | SOYMON035 | g862639 | BLASTN | 746 | 1e−53 | 84 |
| 3240 | 16 | LIB3049-008-Q1-E1-B2 | LIB3049 | g862639 | BLASTN | 864 | 1e−76 | 79 |
| 3241 | 16 | LIB3049-025-Q1-E1-B6 | LIB3049 | g1666172 | BLASTN | 643 | 1e−46 | 79 |
| 3242 | 16 | LIB3049-021-Q1-E1-E11 | LIB3049 | g862639 | BLASTN | 841 | 1e−70 | 78 |
| 3243 | 16 | LIB3049-018-Q1-E1-C6 | LIB3049 | g1666172 | BLASTN | 427 | 1e−36 | 72 |
| 3244 | 16 | LIB3049-016-Q1-E1-G1 | LIB3049 | g862639 | BLASTN | 1006 | 1e−75 | 80 |
| 3245 | 16 | LIB3049-035-Q1-E1-C12 | LIB3049 | g2997614 | BLASTN | 511 | 1e−40 | 78 |
| 3246 | 16 | LIB3049-040-Q1-E1-E6 | LIB3049 | g862639 | BLASTN | 963 | 1e−71 | 82 |
| 3247 | 16 | LIB3049-030-Q1-E1-G12 | LIB3049 | g2997614 | BLASTN | 599 | 1e−40 | 83 |
| 3248 | 16 | LIB3049-034-Q1-E1-B10 | LIB3049 | g2997614 | BLASTN | 1048 | 1e−78 | 79 |
| 3249 | 16 | LIB3049-050-Q1-E1-B8 | LIB3049 | g862639 | BLASTN | 806 | 1e−58 | 84 |
| 3250 | 16 | LIB3049-045-Q1-E1-A8 | LIB3049 | g862639 | BLASTN | 655 | 1e−65 | 78 |
| 3251 | 16 | LIB3056-004-Q1-N1-B8 | LIB3056 | g1666172 | BLASTN | 495 | 1e−36 | 69 |
| 3252 | 16 | LIB3040-010-Q1-E1-E11 | LIB3040 | g1666172 | BLASTN | 1026 | 1e−77 | 83 |
| 3253 | 16 | LIB3040-010-Q1-E1-G10 | LIB3040 | g1619921 | BLASTN | 98 | 1e−35 | 47 |
| 3254 | 16 | LIB3040-009-Q1-E1-H10 | LIB3040 | g1666172 | BLASTN | 944 | 1e−70 | 81 |
| 3255 | 16 | LIB3040-017-Q1-E1-H2 | LIB3040 | g1666172 | BLASTN | 1033 | 1e−77 | 83 |
| 3256 | 16 | LIB3040-047-Q1-E1-F12 | LIB3040 | g1666172 | BLASTN | 869 | 1e−63 | 81 |
| 3257 | 16 | LIB3040-056-Q1-E1-E5 | LIB3040 | g1666172 | BLASTN | 1049 | 1e−79 | 80 |
| 3258 | 16 | LIB3040-040-Q1-E1-D12 | LIB3040 | g1666172 | BLASTN | 1003 | 1e−75 | 82 |
| 3259 | 16 | LIB3040-049-Q1-E1-H9 | LIB3040 | g1666172 | BLASTN | 960 | 1e−71 | 84 |
| 3260 | 16 | LIB3040-049-Q1-E1-G4 | LIB3040 | g1666172 | BLASTN | 1026 | 1e−77 | 83 |
| 3261 | 16 | LIB3040-050-Q1-El-C2 | LIB3040 | g2398527 | BLASTN | 98 | 1e−39 | 53 |
| 3262 | 16 | LIB3040-061-Q1-E11-G7 | LIB3040 | g2398529 | BLASTN | 233 | 1e−51 | 70 |
| 3263 | 16 | LIB3050-017-Q1-E1-E10 | LIB3050 | g2464855 | BLASTN | 66 | 1e−47 | 79 |

SOYBEAN OTHER TRANSCRIPTION FACTORS -continued

| Seq No. | Cluster ID | CloneID | Library | NCBI gi | METHOD | Score | P-Value | % Ident |
|---|---|---|---|---|---|---|---|---|
| 3264 | 16 | LIB3051-008-Q1-E1-F9 | LIB3051 | g1666172 | BLASTN | 1039 | 1e−78 | 79 |
| 3265 | 16 | LIB3051-034-Q1-K1-A12 | LIB3051 | g1666172 | BLASTN | 1041 | 1e−82 | 80 |
| 3266 | 16 | LIB3051-093-Q1-K1-D1 | LIB3051 | g1666172 | BLASTN | 1024 | 1e−77 | 83 |
| 3267 | 16 | LIB3039-024-Q1-E1-A8 | LIB3039 | g1666172 | BLASTN | 736 | 1e−54 | 78 |
| 3268 | 16 | LIB3039-054-Q1-E1-G10 | LIB3039 | g1666172 | BLASTN | 804 | 1e−56 | 82 |
| 3269 | 16211 | 700943357H1 | SOYMON024 | g2832500 | BLASTN | 139 | 1e−22 | 70 |
| 3270 | 16645 | 701098919H1 | SOYMON028 | g2398527 | BLASTN | 61 | 1e−19 | 62 |
| 3271 | 1671 | LIB3029-002-Q1-B1-D1 | LIB3029 | g19490 | BLASTN | 124 | 1e−33 | 70 |
| 3272 | 16724 | LIB3051-088-Q1-K1-D2 | LIB3051 | g2443887 | BLASTN | 185 | 1e−50 | 60 |
| 3273 | 16908 | 700747871H1 | SOYMON013 | g662923 | BLASTN | 699 | 1e−49 | 74 |
| 3274 | 16908 | 700874556H1 | SOYMON018 | g662923 | BLASTN | 312 | 1e−38 | 71 |
| 3275 | 16908 | 700968455H1 | SOYMON036 | g662923 | BLASTN | 627 | 1e−43 | 73 |
| 3276 | 16908 | 701001568H1 | SOYMON018 | g662923 | BLASTN | 283 | 1e−30 | 76 |
| 3277 | 16908 | 701099322H1 | SOYMON028 | g662923 | BLASTN | 651 | 1e−45 | 72 |
| 3278 | 16908 | 701105125H1 | SOYMON036 | g662923 | BLASTN | 264 | 1e−35 | 68 |
| 3279 | 16908 | 701109955H1 | SOYMON036 | g662924 | BLASTN | 154 | 1e−23 | 55 |
| 3280 | 16908 | 701121011H1 | SOYMON037 | g662923 | BLASTN | 420 | 1e−51 | 74 |
| 3281 | 16925 | 700659879H1 | SOYMON004 | g786426 | BLASTN | 226 | 1e−35 | 70 |
| 3282 | 16925 | 700659887H1 | SOYMON004 | g786426 | BLASTN | 122 | 1e−24 | 73 |
| 3283 | 1710 | 700748533H1 | SOYMON013 | g2464855 | BLASTN | 208 | 1e−32 | 83 |
| 3284 | 1710 | 700749045H1 | SOYMON013 | g2464855 | BLASTN | 218 | 1e−32 | 84 |
| 3285 | 1710 | 700832769H1 | SOYMON019 | g2642435 | BLASTN | 194 | 1e−28 | 73 |
| 3286 | 1710 | 700838053H1 | SOYMON020 | g1263095 | BLASTN | 201 | 1e−29 | 83 |
| 3287 | 1710 | 700891690H1 | SOYMON024 | g2642435 | BLASTN | 164 | 1e−24 | 70 |
| 3288 | 1710 | 701207204H1 | SOYMON035 | g1263094 | BLASTN | 441 | 1e−27 | 74 |
| 3289 | 17339 | 701042170H1 | SOYMON029 | g806572 | BLASTN | 84 | 1e−18 | 47 |
| 3290 | 17893 | 700956070H1 | SOYMON022 | g1870205 | BLASTN | 856 | 1e−62 | 86 |
| 3291 | 17893 | 700958586H1 | SOYMON022 | g2827299 | BLASTN | 699 | 1e−49 | 86 |
| 3292 | 17893 | 700963644H1 | SOYMON022 | g1870205 | BLASTN | 522 | 1e−69 | 86 |
| 3293 | 17893 | 701144964H1 | SOYMON031 | g1870205 | BLASTN | 714 | 1e−63 | 85 |
| 3294 | 17893 | LIB3028-004-Q1-B1-B1 | LIB3028 | g1870205 | BLASTN | 1338 | 1e−103 | 87 |
| 3295 | 17946 | 700555866H1 | SOYMON001 | g458966 | BLASTN | 107 | 1e−19 | 56 |
| 3296 | 17975 | 700964776H1 | SOYMON022 | g437326 | BLASTN | 473 | 1e−30 | 78 |
| 3297 | 18102 | 700988653H1 | SOYMON009 | g1239962 | BLASTN | 297 | 1e−13 | 83 |
| 3298 | 18102 | 701205092H1 | SOYMON035 | g1239962 | BLASTN | 292 | 1e−13 | 85 |
| 3299 | 18281 | 700605666H2 | SOYMON005 | g2104678 | BLASTN | 1044 | 1e−78 | 90 |
| 3300 | 18281 | 700850452H1 | SOYMON023 | g2104678 | BLASTN | 1040 | 1e−77 | 88 |
| 3301 | 1836 | 700760932H1 | SOYMON015 | g1838976 | BLASTN | 150 | 1e−22 | 41 |
| 3302 | 1836 | 700889116H1 | SOYMON024 | g1838976 | BLASTN | 220 | 1e−31 | 54 |
| 3303 | 1836 | 700907585H1 | SOYMON022 | g1838976 | BLASTN | 203 | 1e−29 | 50 |
| 3304 | 18530 | 700568369H1 | SOYMON002 | g1763062 | BLASTN | 560 | 1e−74 | 85 |
| 3305 | 18530 | 700568669H1 | SOYMON002 | g1763062 | BLASTN | 642 | 1e−78 | 84 |
| 3306 | 18637 | 700797246H1 | SOYMON017 | g1483227 | BLASTN | 486 | 1e−31 | 70 |
| 3307 | 18637 | 700875563H1 | SOYMON018 | g1483229 | BLASTN | 627 | 1e−43 | 79 |
| 3308 | 18777 | 700843983H1 | SOYMON021 | g1841475 | BLASTN | 164 | 1e−30 | 65 |
| 3309 | 18777 | 700874360H1 | SOYMON018 | g1841475 | BLASTN | 281 | 1e−41 | 66 |
| 3310 | 1889 | 700561112H1 | SOYMON002 | g556557 | BLASTN | 261 | 1e−10 | 71 |
| 3311 | 1889 | 700750726H1 | SOYMON014 | g556557 | BLASTN | 266 | 1e−11 | 68 |
| 3312 | 1889 | 700750779H1 | SOYMON014 | g556557 | BLASTN | 298 | 1e−14 | 72 |
| 3313 | 1889 | 700752732H1 | SOYMON014 | g556557 | BLASTN | 291 | 1e−13 | 71 |
| 3314 | 1889 | 700757643H1 | SOYMON015 | g556557 | BLASTN | 291 | 1e−13 | 71 |
| 3315 | 1889 | 700905493H1 | SOYMON022 | g556557 | BLASTN | 295 | 1e−13 | 73 |
| 3316 | 1889 | 700981311H1 | SOYMON009 | g556557 | BLASTN | 298 | 1e−13 | 72 |
| 3317 | 1889 | 701038688H1 | SOYMON029 | g556557 | BLASTN | 306 | 1e−14 | 74 |
| 3318 | 1889 | 701046114H1 | SOYMON032 | g556557 | BLASTN | 298 | 1e−13 | 72 |
| 3319 | 1889 | 701051332H1 | SOYMON032 | g556558 | BLASTN | 65 | 1e−21 | 73 |
| 3320 | 1889 | 701065316H1 | SOYMON034 | g556557 | BLASTN | 238 | 1e−08 | 67 |
| 3321 | 1889 | 701142106H1 | SOYMON038 | g556557 | BLASTN | 298 | 1e−13 | 72 |
| 3322 | 1889 | 701142830H1 | SOYMON038 | g556558 | BLASTN | 74 | 1e−21 | 60 |
| 3323 | 1889 | 701211964H1 | SOYMON035 | g556558 | BLASTN | 123 | 1e−25 | 74 |
| 3324 | 1889 | 701214543H1 | SOYMON035 | g556557 | BLASTN | 287 | 1e−13 | 72 |
| 3325 | 19058 | 700685158H1 | SOYMON008 | g2564336 | BLASTN | 566 | 1e−63 | 82 |
| 3326 | 19058 | 700890768H1 | SOYMON024 | g2564336 | BLASTN | 836 | 1e−60 | 82 |
| 3327 | 19058 | 700893168H1 | SOYMON024 | g2564336 | BLASTN | 796 | 1e−57 | 85 |
| 3328 | 19058 | 701038060H1 | SOYMON029 | g2564336 | BLASTN | 516 | 1e−67 | 84 |
| 3329 | 19058 | 701056570H1 | SOYMON032 | g2564336 | BLASTN | 724 | 1e−61 | 83 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3330 | 19058 | 701098778H2 | SOYMON028 | g2564336 | BLASTN | 878 | 1e−64 | 83 |
| 3331 | 19058 | LIB3028-004-Q1-B1-A10 | LIB3028 | g2564336 | BLASTN | 976 | 1e−72 | 83 |
| 3332 | 19058 | LIB3028-003-Q1-B1-G10 | LIB3028 | g2564336 | BLASTN | 1071 | 1e−80 | 82 |
| 3333 | 19131 | 700755494H1 | SOYMON014 | g171854 | BLASTN | 139 | 1e−25 | 43 |
| 3334 | 19131 | 700964067H1 | SOYMON022 | g171854 | BLASTN | 72 | 1e−17 | 38 |
| 3335 | 19220 | 700905665H1 | SOYMON022 | g22666 | BLASTN | 594 | 1e−40 | 83 |
| 3336 | 19220 | 700964291H1 | SOYMON022 | g22666 | BLASTN | 584 | 1e−39 | 82 |
| 3337 | 19220 | LIB3030-006-Q1-B1-D8 | LIB3030 | g454264 | BLASTN | 569 | 1e−36 | 82 |
| 3338 | 19380 | 700655519H1 | SOYMON004 | g2826884 | BLASTN | 113 | 1e−25 | 67 |
| 3339 | 19380 | 700739869H1 | SOYMON012 | g1429226 | BLASTN | 112 | 1e−22 | 55 |
| 3340 | 19380 | 700789758H1 | SOYMON011 | g1429225 | BLASTN | 246 | 1e−19 | 75 |
| 3341 | 19380 | 700792582H1 | SOYMON017 | g1429225 | BLASTN | 246 | 1e−18 | 75 |
| 3342 | 19380 | 701008550H1 | SOYMON019 | g2826883 | BLASTN | 251 | 1e−12 | 76 |
| 3343 | 19380 | LIB3051-027-Q1-K1-D8 | LIB3051 | g2826883 | BLASTN | 246 | 1e−32 | 72 |
| 3344 | 19762 | 700866853H1 | SOYMON016 | g1002800 | BLASTN | 254 | 1e−37 | 66 |
| 3345 | 19762 | 701100144H1 | SOYMON028 | g1841475 | BLASTN | 281 | 1e−42 | 67 |
| 3346 | 19797 | 700738185H1 | SOYMON012 | g556409 | BLASTN | 155 | 1e−23 | 67 |
| 3347 | 19797 | 700846152H1 | SOYMON021 | g556409 | BLASTN | 161 | 1e−24 | 68 |
| 3348 | 19797 | 701068317H1 | SOYMON034 | g556409 | BLASTN | 143 | 1e−21 | 69 |
| 3349 | 19797 | 701214636H1 | SOYMON035 | g556409 | BLASTN | 200 | 1e−29 | 65 |
| 3350 | 19895 | 700853650H1 | SOYMON023 | g671866 | BLASTN | 79 | 1e−20 | 47 |
| 3351 | 20008 | 700848389H1 | SOYMON021 | g218339 | BLASTN | 765 | 1e−54 | 78 |
| 3352 | 20008 | 700868254H1 | SOYMON016 | g218339 | BLASTN | 673 | 1e−47 | 73 |
| 3353 | 20008 | 701042960H1 | SOYMON029 | g218339 | BLASTN | 537 | 1e−35 | 75 |
| 3354 | 2003 | 700548274H1 | SOYMON002 | g2564336 | BLASTN | 782 | 1e−56 | 81 |
| 3355 | 2003 | 700568521H1 | SOYMON002 | g2564336 | BLASTN | 582 | 1e−51 | 77 |
| 3356 | 2003 | 700651072H1 | SOYMON003 | g2564336 | BLASTN | 557 | 1e−36 | 83 |
| 3357 | 2003 | 700653758H1 | SOYMON003 | g2564336 | BLASTN | 512 | 1e−35 | 80 |
| 3358 | 2003 | 700669768H1 | SOYMON006 | g556559 | BLASTN | 276 | 1e−26 | 76 |
| 3359 | 2003 | 700729235H1 | SOYMON009 | g2564336 | BLASTN | 695 | 1e−49 | 81 |
| 3360 | 2003 | 700753886H1 | SOYMON014 | g556559 | BLASTN | 190 | 1e−09 | 67 |
| 3361 | 2003 | 700852039H1 | SOYMON023 | g2564336 | BLASTN | 565 | 1e−38 | 80 |
| 3362 | 2003 | 700866142H1 | SOYMON016 | g556559 | BLASTN | 698 | 1e−49 | 81 |
| 3363 | 2003 | 700908428H1 | SOYMON022 | g2564336 | BLASTN | 591 | 1e−40 | 79 |
| 3364 | 2003 | 700964754H1 | SOYMON022 | g556559 | BLASTN | 592 | 1e−55 | 81 |
| 3365 | 2003 | 700970722H1 | SOYMON005 | g2564336 | BLASTN | 342 | 1e−31 | 77 |
| 3366 | 2003 | 700985005H1 | SOYMON009 | g2564336 | BLASTN | 478 | 1e−29 | 76 |
| 3367 | 2003 | 701042245H1 | SOYMON029 | g2564336 | BLASTN | 508 | 1e−33 | 79 |
| 3368 | 2003 | 701154842H1 | SOYMON031 | g2564336 | BLASTN | 598 | 1e−41 | 79 |
| 3369 | 2003 | LIB3049-028-Q1-E1-E3 | LIB3049 | g2564336 | BLASTN | 1069 | 1e−80 | 80 |
| 3370 | 2003 | LIB3040-043-Q1-E1-D1 | LIB3040 | g2564336 | BLASTN | 820 | 1e−59 | 81 |
| 3371 | 20078 | 700864959H1 | SOYMON016 | g1430845 | BLASTN | 507 | 1e−33 | 85 |
| 3372 | 20078 | 701013405H1 | SOYMON019 | g1430845 | BLASTN | 494 | 1e−32 | 85 |
| 3373 | 20078 | 701065214H1 | SOYMON034 | g1430845 | BLASTN | 425 | 1e−26 | 81 |
| 3374 | 20227 | 700736883H1 | SOYMON010 | g1046277 | BLASTN | 271 | 1e−44 | 82 |
| 3375 | 20227 | 700973255H1 | SOYMON005 | g1046277 | BLASTN | 480 | 1e−55 | 84 |
| 3376 | 20546 | 700786044H2 | SOYMON011 | g556557 | BLASTN | 557 | 1e−43 | 74 |
| 3377 | 20546 | 700964196H1 | SOYMON022 | g556557 | BLASTN | 663 | 1e−46 | 74 |
| 3378 | 20546 | 701213977H1 | SOYMON035 | g556557 | BLASTN | 350 | 1e−18 | 75 |
| 3379 | 20546 | LIB3051-025-Q1-K1-F6 | LIB3051 | g556557 | BLASTN | 751 | 1e−52 | 75 |
| 3380 | 20546 | LIB3051-038-Q1-K1-E12 | LIB3051 | g556557 | BLASTN | 231 | 1e−30 | 72 |
| 3381 | 20913 | 700996245H1 | SOYMON018 | g1747309 | BLASTN | 577 | 1e−39 | 85 |
| 3382 | 20913 | 701106878H1 | SOYMON036 | g1747309 | BLASTN | 458 | 1e−28 | 86 |
| 3383 | 20913 | LIB3049-028-Q1-E1-B7 | LIB3049 | g1747309 | BLASTN | 566 | 1e−37 | 85 |
| 3384 | 20938 | 701002037H1 | SOYMON018 | g2398523 | BLASTN | 149 | 1e−32 | 70 |
| 3385 | 20938 | 701002433H1 | SOYMON018 | g2398523 | BLASTN | 101 | 1e−30 | 69 |
| 3386 | 20945 | 701002632H1 | SOYMON018 | g662925 | BLASTN | 1057 | 1e−83 | 98 |
| 3387 | 20945 | 701068738H1 | SOYMON034 | g662925 | BLASTN | 715 | 1e−50 | 97 |
| 3388 | 21003 | 701039535H1 | SOYMON029 | g2344890 | BLASTN | 77 | 1e−18 | 77 |
| 3389 | 21067 | 701059019H1 | SOYMON033 | g2564336 | BLASTN | 679 | 1e−63 | 82 |
| 3390 | 21067 | 701134137H1 | SOYMON038 | g2564336 | BLASTN | 936 | 1e−69 | 85 |
| 3391 | 21246 | 700909696H1 | SOYMON022 | g2505876 | BLASTN | 125 | 1e−18 | 85 |
| 3392 | 21332 | 700744681H1 | SOYMON013 | g662925 | BLASTN | 610 | 1e−79 | 96 |
| 3393 | 21332 | 700744690H1 | SOYMON013 | g662925 | BLASTN | 585 | 1e−83 | 99 |
| 3394 | 21332 | 700749490H1 | SOYMON013 | g662925 | BLASTN | 1124 | 1e−84 | 97 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3395 | 21499 | 701131617H1 | SOYMON038 | g2564336 | BLASTN | 717 | 1e-50 | 79 |
| 3396 | 21499 | 701137157H1 | SOYMON038 | g2564336 | BLASTN | 559 | 1e-37 | 79 |
| 3397 | 21748 | 700845880H1 | SOYMON021 | g19260 | BLASTN | 152 | 1e-22 | 51 |
| 3398 | 21802 | 701037159H1 | SOYMON029 | g20560 | BLASTN | 519 | 1e-34 | 74 |
| 3399 | 21802 | 701041007H1 | SOYMON029 | g20560 | BLASTN | 647 | 1e-45 | 73 |
| 3400 | 21919 | 700961280H1 | SOYMON022 | g2104679 | BLASTN | 196 | 1e-29 | 92 |
| 3401 | 21967 | 701058447H1 | SOYMON033 | g2257568 | BLASTN | 176 | 1e-26 | 48 |
| 3402 | 21967 | 701100978H1 | SOYMON028 | g2257568 | BLASTN | 199 | 1e-29 | 56 |
| 3403 | 22873 | 701145018H1 | SOYMON031 | g1946267 | BLASTN | 174 | 1e-29 | 65 |
| 3404 | 22873 | 701145825H1 | SOYMON031 | g20562 | BLASTN | 534 | 1e-35 | 77 |
| 3405 | 22873 | 701146735H1 | SOYMON031 | g1946267 | BLASTN | 122 | 1e-31 | 76 |
| 3406 | 22873 | 701149369H1 | SOYMON031 | g20562 | BLASTN | 438 | 1e-27 | 77 |
| 3407 | 22873 | 701149568H1 | SOYMON031 | g20562 | BLASTN | 545 | 1e-36 | 77 |
| 3408 | 22873 | 701149640H1 | SOYMON031 | g20562 | BLASTN | 545 | 1e-36 | 77 |
| 3409 | 22873 | 701152857H1 | SOYMON031 | g20562 | BLASTN | 517 | 1e-34 | 78 |
| 3410 | 22873 | 701155263H1 | SOYMON031 | g20562 | BLASTN | 454 | 1e-28 | 77 |
| 3411 | 22873 | 701155295H1 | SOYMON031 | g20562 | BLASTN | 542 | 1e-36 | 74 |
| 3412 | 23065 | 700832243H1 | SOYMON019 | g786425 | BLASTN | 262 | 1e-11 | 80 |
| 3413 | 23065 | 701122643H1 | SOYMON037 | g786426 | BLASTN | 115 | 1e-21 | 54 |
| 3414 | 23065 | 701209387H1 | SOYMON035 | g786425 | BLASTN | 449 | 1e-27 | 74 |
| 3415 | 23501 | LIB3055-005-Q1-N1-C5 | LIB3055 | g516869 | BLASTN | 160 | 1e-39 | 42 |
| 3416 | 23562 | 701014653H1 | SOYMON019 | g1890351 | BLASTN | 572 | 1e-38 | 71 |
| 3417 | 23562 | 701038207H1 | SOYMON029 | g1890351 | BLASTN | 337 | 1e-33 | 71 |
| 3418 | 23562 | 701122917H1 | SOYMON037 | g1890351 | BLASTN | 441 | 1e-26 | 70 |
| 3419 | 23580 | 700967350H1 | SOYMON031 | g2196466 | BLASTN | 209 | 1e-30 | 53 |
| 3420 | 23580 | 701047984H1 | SOYMON032 | g2196465 | BLASTN | 480 | 1e-31 | 65 |
| 3421 | 23831 | 700893088H1 | SOYMON024 | g2398528 | BLASTN | 569 | 1e-38 | 82 |
| 3422 | 23831 | 701003767H1 | SOYMON019 | g2398528 | BLASTN | 523 | 1e-34 | 84 |
| 3423 | 23831 | 701011688H1 | SOYMON019 | g2398528 | BLASTN | 498 | 1e-32 | 83 |
| 3424 | 24059 | 701212031H1 | SOYMON035 | g309570 | BLASTN | 289 | 1e-49 | 60 |
| 3425 | 24059 | 701212619H1 | SOYMON035 | g1101769 | BLASTN | 455 | 1e-27 | 65 |
| 3426 | 24059 | 701214572H1 | SOYMON035 | g2343273 | BLASTN | 241 | 1e-47 | 64 |
| 3427 | 2408 | 700754509H1 | SOYMON014 | g2145357 | BLASTN | 399 | 1e-60 | 83 |
| 3428 | 2408 | 700755930H1 | SOYMON014 | g2145357 | BLASTN | 387 | 1e-49 | 83 |
| 3429 | 24250 | 700679378H1 | SOYMON007 | g2244810 | BLASTN | 76 | 1e-28 | 87 |
| 3430 | 24250 | 701046531H1 | SOYMON032 | g22379 | BLASTN | 625 | 1e-43 | 78 |
| 3431 | 2440 | 700650738H1 | SOYMON003 | g1100994 | BLASTN | 91 | 1e-22 | 38 |
| 3432 | 2440 | 700653187H1 | SOYMON003 | g1100994 | BLASTN | 106 | 1e-23 | 55 |
| 3433 | 2440 | 700662649H1 | SOYMON005 | g1100994 | BLASTN | 91 | 1e-17 | 41 |
| 3434 | 2440 | 701005967H1 | SOYMON019 | g1100994 | BLASTN | 102 | 1e-25 | 51 |
| 3435 | 24690 | 701010664H1 | SOYMON019 | g1002799 | BLASTN | 480 | 1e-29 | 71 |
| 3436 | 24690 | LIB3050-023-Q1-K1-F5 | LIB3050 | g1732513 | BLASTN | 134 | 1e-51 | 66 |
| 3437 | 25167 | 701009020H1 | SOYMON019 | g1167485 | BLASTN | 454 | 1e-27 | 70 |
| 3438 | 25176 | 700562348H1 | SOYMON002 | g1899057 | BLASTN | 570 | 1e-38 | 74 |
| 3439 | 25548 | 701105042H1 | SOYMON036 | g2245134 | BLASTN | 67 | 1e-17 | 37 |
| 3440 | 25548 | 701120925H1 | SOYMON037 | g2245134 | BLASTN | 120 | 1e-18 | 62 |
| 3441 | 25548 | 701210143H1 | SOYMON035 | g19260 | BLASTN | 116 | 1e-17 | 71 |
| 3442 | 25580 | 700907219H1 | SOYMON022 | g1870205 | BLASTN | 640 | 1e-44 | 75 |
| 3443 | 25580 | 701153366H1 | SOYMON031 | g1046271 | BLASTN | 567 | 1e-38 | 76 |
| 3444 | 25580 | 701207013H1 | SOYMON035 | g1870205 | BLASTN | 615 | 1e-42 | 74 |
| 3445 | 25580 | 701209467H1 | SOYMON035 | g22666 | BLASTN | 567 | 1e-38 | 79 |
| 3446 | 25580 | LIB3049-051-Q1-E1-H4 | LIB3049 | g1870205 | BLASTN | 642 | 1e-57 | 75 |
| 3447 | 25580 | LIB3028-030-Q1-B1-G8 | LIB3028 | g1870205 | BLASTN | 640 | 1e-51 | 76 |
| 3448 | 25755 | 701049112H1 | SOYMON032 | g1429226 | BLASTN | 121 | 1e-18 | 76 |
| 3449 | 25854 | 701123518H1 | SOYMON037 | g2398532 | BLASTN | 790 | 1e-57 | 77 |
| 3450 | 26035 | 700993991H1 | SOYMON011 | g2505876 | BLASTN | 176 | 1e-26 | 66 |
| 3451 | 26035 | 701044819H1 | SOYMON032 | g2505876 | BLASTN | 170 | 1e-25 | 65 |
| 3452 | 26620 | 701156706H1 | SOYMON031 | g1206002 | BLASTN | 556 | 1e-37 | 70 |
| 3453 | 26620 | 701157007H1 | SOYMON031 | g1239960 | BLASTN | 437 | 1e-26 | 65 |
| 3454 | 26979 | 700853506H1 | SOYMON023 | g556557 | BLASTN | 640 | 1e-44 | 78 |
| 3455 | 26979 | 701052874H1 | SOYMON032 | g556557 | BLASTN | 911 | 1e-67 | 82 |
| 3456 | 27155 | 701210746H1 | SOYMON035 | g556408 | BLASTN | 280 | 1e-12 | 70 |
| 3457 | 27155 | 701211562H1 | SOYMON035 | g556408 | BLASTN | 314 | 1e-15 | 70 |
| 3458 | 27697 | 700677948H1 | SOYMON007 | g2398527 | BLASTN | 123 | 1e-22 | 65 |
| 3459 | 27697 | 701125758H1 | SOYMON037 | g22379 | BLASTN | 525 | 1e-43 | 73 |
| 3460 | 27778 | 700658844H1 | SOYMON004 | g2104680 | BLASTN | 772 | 1e-55 | 79 |
| 3461 | 27778 | 700787104H2 | SOYMON011 | g2104680 | BLASTN | 767 | 1e-60 | 80 |
| 3462 | 27778 | 701148053H1 | SOYMON031 | g2104680 | BLASTN | 772 | 1e-55 | 79 |
| 3463 | 27778 | LIB3054-004-Q1-N1-H8 | LIB3054 | g2104680 | BLASTN | 1084 | 1e-81 | 82 |

SOYBEAN OTHER TRANSCRIPTION FACTORS -continued

| Seq No. | Cluster ID | CloneID | Library | NCBI gi | METHOD | Score | P-Value | % Ident |
|---|---|---|---|---|---|---|---|---|
| 3464 | 27778 | LIB3050-006-Q1-E1-B4 | LIB3050 | g2104680 | BLASTN | 955 | 1e-73 | 77 |
| 3465 | 27977 | 700994095H1 | SOYMON011 | g556557 | BLASTN | 857 | 1e-62 | 82 |
| 3466 | 27977 | 701203544H2 | SOYMON035 | g556557 | BLASTN | 824 | 1e-59 | 81 |
| 3467 | 28017 | 700834026H1 | SOYMON019 | g2832407 | BLASTN | 677 | 1e-47 | 76 |
| 3468 | 28017 | 701004442H1 | SOYMON019 | g2832407 | BLASTN | 585 | 1e-39 | 76 |
| 3469 | 28100 | 701044845H1 | SOYMON032 | g1002800 | BLASTN | 147 | 1e-24 | 81 |
| 3470 | 28100 | 701102677H1 | SOYMON028 | g1002800 | BLASTN | 157 | 1e-23 | 81 |
| 3471 | 28161 | 701005049H1 | SOYMON019 | g662929 | BLASTN | 189 | 1e-13 | 73 |
| 3472 | 28161 | 701042306H1 | SOYMON029 | g662929 | BLASTN | 322 | 1e-16 | 68 |
| 3473 | 28204 | 700663342H1 | SOYMON005 | g1838976 | BLASTN | 131 | 1e-30 | 63 |
| 3474 | 28204 | 701122846H1 | SOYMON037 | g1838975 | BLASTN | 564 | 1e-38 | 74 |
| 3475 | 28204 | 701206602H1 | SOYMON035 | g1838976 | BLASTN | 130 | 1e-19 | 40 |
| 3476 | 28204 | LIB3050-023-Q1-K1-H4 | LIB3050 | g1838975 | BLASTN | 748 | 1e-51 | 67 |
| 3477 | 28204 | LIB3051-003-Q1-E1-G12 | LIB3051 | g1838975 | BLASTN | 680 | 1e-45 | 65 |
| 3478 | 28346 | 700671032H1 | SOYMON006 | g1171428 | BLASTN | 446 | 1e-26 | 78 |
| 3479 | 28438 | LIB3049-003-Q1-E1-E8 | LIB3049 | g2245390 | BLASTN | 159 | 1e-41 | 87 |
| 3480 | 2879 | 700725235H1 | SOYMON009 | g1183866 | BLASTN | 176 | 1e-38 | 68 |
| 3481 | 2886 | 700959889H1 | SOYMON022 | g172637 | BLASTN | 240 | 1e-09 | 65 |
| 3482 | 291 | 700657232H1 | SOYMON004 | g2398527 | BLASTN | 93 | 1e-23 | 78 |
| 3483 | 291 | 700754192H1 | SOYMON014 | g22379 | BLASTN | 452 | 1e-35 | 82 |
| 3484 | 291 | 700899456H1 | SOYMON027 | g2398527 | BLASTN | 121 | 1e-19 | 92 |
| 3485 | 291 | 700969546H1 | SOYMON005 | g2398527 | BLASTN | 120 | 1e-24 | 78 |
| 3486 | 291 | 701064889H1 | SOYMON034 | g2398527 | BLASTN | 80 | 1e-22 | 75 |
| 3487 | 291 | 701122985H1 | SOYMON037 | g22379 | BLASTN | 494 | 1e-37 | 83 |
| 3488 | 291 | 701133572H2 | SOYMON038 | g22379 | BLASTN | 484 | 1e-37 | 81 |
| 3489 | 29481 | 700738814H1 | SOYMON010 | g1430847 | BLASTN | 642 | 1e-44 | 77 |
| 3490 | 29660 | LIB3050-015-Q1-E1-H2 | LIB3050 | g2464855 | BLASTN | 91 | 1e-44 | 78 |
| 3491 | 29660 | LIB3053-001-Q1-B1-D9 | LIB3053 | g1263095 | BLASTN | 101 | 1e-44 | 59 |
| 3492 | 30057 | LIB3049-041-Q1-E1-F9 | LIB3049 | g2920839 | BLASTN | 255 | 1e-55 | 51 |
| 3493 | 30591 | 700786351H1 | SOYMON011 | g2104680 | BLASTN | 225 | 1e-17 | 86 |
| 3494 | 30591 | LIB3049-015-Q1-E1-C8 | LIB3049 | g2104680 | BLASTN | 324 | 1e-18 | 76 |
| 3495 | 30776 | 701132894H1 | SOYMON038 | g1430848 | BLASTN | 86 | 1e-22 | 75 |
| 3496 | 30776 | LIB3051-072-Q1-K1-D1 | LIB3051 | g1430848 | BLASTN | 144 | 1e-42 | 73 |
| 3497 | 30802 | 700679829H1 | SOYMON007 | g1232130 | BLASTN | 159 | 1e-24 | 71 |
| 3498 | 30802 | LIB3051-061-Q1-K1-D12 | LIB3051 | g1232130 | BLASTN | 159 | 1e-40 | 55 |
| 3499 | 31069 | 700731911H1 | SOYMON010 | g1181185 | BLASTN | 367 | 1e-44 | 78 |
| 3500 | 31069 | LIB3028-002-Q1-B1-B2 | LIB3028 | g3184053 | BLASTN | 1421 | 1e-110 | 87 |
| 3501 | 31069 | LIB3049-007-Q1-E1-E6 | LIB3049 | g3184053 | BLASTN | 817 | 1e-65 | 90 |
| 3502 | 31384 | 700651585H1 | SOYMON003 | g786426 | BLASTN | 161 | 1e-26 | 54 |
| 3503 | 31384 | LIB3051-005-Q1-E1-G9 | LIB3051 | g786426 | BLASTN | 180 | 1e-42 | 55 |
| 3504 | 31476 | 700905514H1 | SOYMON022 | g433634 | BLASTN | 271 | 1e-11 | 67 |
| 3505 | 31476 | LIB3051-042-Q1-K1-C7 | LIB3051 | g433634 | BLASTN | 271 | 1e-11 | 67 |
| 3506 | 3153 | 700560933H1 | SOYMON001 | g20562 | BLASTN | 1011 | 1e-75 | 84 |
| 3507 | 3153 | 701107472H1 | SOYMON036 | g20562 | BLASTN | 813 | 1e-58 | 83 |
| 3508 | 3153 | 701141189H1 | SOYMON038 | g20562 | BLASTN | 887 | 1e-65 | 82 |
| 3509 | 3153 | 701142353H1 | SOYMON038 | g20562 | BLASTN | 790 | 1e-60 | 80 |
| 3510 | 3156 | 700548233H1 | SOYMON002 | g662930 | BLASTN | 226 | 1e-33 | 69 |
| 3511 | 3156 | 700836407H1 | SOYMON020 | g662930 | BLASTN | 131 | 1e-20 | 67 |
| 3512 | 3156 | 700836443H1 | SOYMON020 | g2464881 | BLASTN | 131 | 1e-19 | 61 |
| 3513 | 3156 | 700852876H1 | SOYMON023 | g662930 | BLASTN | 176 | 1e-35 | 68 |
| 3514 | 3156 | 701134888H2 | SOYMON038 | g19488 | BLASTN | 219 | 1e-32 | 71 |
| 3515 | 31655 | LIB3065-006-Q1-N1-D1 | LIB3065 | g2921333 | BLASTN | 649 | 1e-43 | 69 |
| 3516 | 31655 | LIB3065-006-Q1-N1-F4 | LIB3065 | g2921333 | BLASTN | 651 | 1e-43 | 67 |
| 3517 | 31674 | 700896653H1 | SOYMON027 | g945086 | BLASTN | 1303 | 1e-100 | 98 |
| 3518 | 31674 | LIB3051-030-Q1-K1-H12 | LIB3051 | g945086 | BLASTN | 1799 | 1e-153 | 94 |
| 3519 | 31973 | 701108371H1 | SOYMON036 | g662929 | BLASTN | 937 | 1e-79 | 95 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3520 | 31973 | LIB3049-048-Q1-E1-F11 | LIB3049 | g662929 | BLASTN | 1317 | 1e−105 | 78 |
| 3521 | 3229 | 700831738H1 | SOYMON019 | g1946267 | BLASTN | 260 | 1e−38 | 70 |
| 3522 | 3229 | 700870313H1 | SOYMON016 | g1946267 | BLASTN | 234 | 1e−34 | 72 |
| 3523 | 32348 | LIB3051-045-Q1-K1-E8 | LIB3051 | g2104680 | BLASTN | 183 | 1e−11 | 77 |
| 3524 | 32814 | 700852749H1 | SOYMON023 | g556557 | BLASTN | 798 | 1e−57 | 80 |
| 3525 | 32814 | LIB3049-002-Q1-E1-F12 | LIB3049 | g556557 | BLASTN | 1071 | 1e−80 | 77 |
| 3526 | 32958 | 700896355H1 | SOYMON027 | g1263095 | BLASTN | 92 | 1e−20 | 78 |
| 3527 | 32958 | LIB3055-013-Q1-N1-G5 | LIB3055 | g1263095 | BLASTN | 99 | 1e−36 | 73 |
| 3528 | 33430 | 700670286H1 | SOYMON006 | g19260 | BLASTN | 145 | 1e−23 | 67 |
| 3529 | 33430 | LIB3051-008-Q1-E1-A6 | LIB3051 | g19491 | BLASTN | 378 | 1e−31 | 64 |
| 3530 | 33452 | 700728414H1 | SOYMON009 | g2104680 | BLASTN | 643 | 1e−60 | 85 |
| 3531 | 33452 | LIB3050-020-Q1-K1-D11 | LIB3050 | g2104680 | BLASTN | 805 | 1e−63 | 80 |
| 3532 | 33477 | 700894136H1 | SOYMON024 | g2702280 | BLASTN | 80 | 1e−21 | 52 |
| 3533 | 33477 | LIB3051-083-Q1-K1-E1 | LIB3051 | g2702280 | BLASTN | 189 | 1e−58 | 49 |
| 3534 | 33485 | 701202635H1 | SOYMON035 | g1568512 | BLASTN | 472 | 1e−30 | 73 |
| 3535 | 33485 | LIB3051-059-Q1-K2-E10 | LIB3051 | g1568512 | BLASTN | 503 | 1e−30 | 74 |
| 3536 | 3358 | 700558937H1 | SOYMON001 | g662929 | BLASTN | 1048 | 1e−78 | 98 |
| 3537 | 3358 | 700853374H1 | SOYMON023 | g662929 | BLASTN | 880 | 1e−84 | 98 |
| 3538 | 3366 | 700564935H1 | SOYMON002 | g1899058 | BLASTN | 104 | 1e−20 | 70 |
| 3539 | 3366 | 700750112H1 | SOYMON013 | g1899057 | BLASTN | 477 | 1e−30 | 65 |
| 3540 | 3366 | 700867871H1 | SOYMON016 | g1899058 | BLASTN | 115 | 1e−17 | 71 |
| 3541 | 3366 | 700897446H1 | SOYMON027 | g1899058 | BLASTN | 126 | 1e−19 | 72 |
| 3542 | 3366 | 701013517H1 | SOYMON019 | g1899058 | BLASTN | 194 | 1e−29 | 67 |
| 3543 | 3366 | 701128079H1 | SOYMON037 | g1899058 | BLASTN | 167 | 1e−25 | 60 |
| 3544 | 3366 | LIB3056-001-Q1-B1-B4 | LIB3056 | g2980802 | BLASTN | 214 | 1e−47 | 62 |
| 3545 | 33681 | 701208255H1 | SOYMON035 | g786426 | BLASTN | 99 | 1e−19 | 83 |
| 3546 | 33681 | LIB3051-067-Q1-K1-C1 | LIB3051 | g2062176 | BLASTN | 121 | 1e−50 | 56 |
| 3547 | 33852 | 701138263H1 | SOYMON038 | g1183866 | BLASTN | 197 | 1e−31 | 65 |
| 3548 | 33852 | LIB3051-079-Q1-K1-B11 | LIB3051 | g1707009 | BLASTN | 245 | 1e−53 | 55 |
| 3549 | 3479 | 700558834H1 | SOYMON001 | g19260 | BLASTN | 119 | 1e−18 | 52 |
| 3550 | 3564 | 700661347H1 | SOYMON005 | g2104680 | BLASTN | 308 | 1e−14 | 80 |
| 3551 | 3564 | 700829613H1 | SOYMON019 | g2104680 | BLASTN | 235 | 1e−08 | 85 |
| 3552 | 3564 | 700850396H1 | SOYMON023 | g2104680 | BLASTN | 118 | 1e−18 | 88 |
| 3553 | 3564 | 700899102H1 | SOYMON027 | g2104681 | BLASTN | 114 | 1e−17 | 88 |
| 3554 | 3564 | 700905639H1 | SOYMON022 | g2104681 | BLASTN | 127 | 1e−19 | 89 |
| 3555 | 3564 | 700959049H1 | SOYMON022 | g2104680 | BLASTN | 235 | 1e−09 | 78 |
| 3556 | 3564 | 700973814H1 | SOYMON005 | g2104680 | BLASTN | 235 | 1e−09 | 88 |
| 3557 | 3564 | 700982810H1 | SOYMON009 | g2104680 | BLASTN | 234 | 1e−09 | 74 |
| 3558 | 3564 | 701001146H1 | SOYMON018 | g2104680 | BLASTN | 239 | 1e−09 | 74 |
| 3559 | 3564 | 701012290H1 | SOYMON019 | g2104681 | BLASTN | 114 | 1e−17 | 88 |
| 3560 | 3564 | 701013913H1 | SOYMON019 | g2104680 | BLASTN | 235 | 1e−08 | 85 |
| 3561 | 3564 | 701038255H1 | SOYMON029 | g2104680 | BLASTN | 235 | 1e−10 | 70 |
| 3562 | 3564 | 701038727H1 | SOYMON029 | g2104681 | BLASTN | 105 | 1e−22 | 89 |
| 3563 | 3564 | 701045377H1 | SOYMON032 | g2104680 | BLASTN | 228 | 1e−09 | 69 |
| 3564 | 3564 | 701064305H1 | SOYMON034 | g2104680 | BLASTN | 235 | 1e−08 | 85 |
| 3565 | 3564 | 701105787H1 | SOYMON036 | g2104680 | BLASTN | 235 | 1e−09 | 78 |
| 3566 | 3564 | LIB3065-008-Q1-N1-G11 | LIB3065 | g2104680 | BLASTN | 308 | 1e−15 | 69 |
| 3567 | 3564 | LIB3029-007-Q1-B1-G6 | LIB3029 | g2104681 | BLASTN | 118 | 1e−34 | 88 |
| 3568 | 3564 | LIB3051-064-Q1-K1-H3 | LIB3051 | g2104681 | BLASTN | 118 | 1e−39 | 77 |
| 3569 | 3739 | 700678057H1 | SOYMON007 | g167727 | BLASTN | 217 | 1e−08 | 75 |
| 3570 | 3756 | 700750091H1 | SOYMON013 | g1838975 | BLASTN | 369 | 1e−20 | 74 |
| 3571 | 3756 | 700896732H1 | SOYMON027 | g1838975 | BLASTN | 365 | 1e−19 | 76 |
| 3572 | 3757 | 700906204H1 | SOYMON022 | g1945281 | BLASTN | 76 | 1e−18 | 49 |
| 3573 | 3757 | LIB3040-025-Q1-E1-B10 | LIB3040 | g3183616 | BLASTN | 662 | 1e−44 | 72 |
| 3574 | 3757 | LIB3040-058-Q1-E1-D7 | LIB3040 | g3183617 | BLASTN | 347 | 1e−66 | 78 |
| 3575 | 3757 | LIB3039-014-Q1-E1-E11 | LIB3039 | g3183616 | BLASTN | 779 | 1e−55 | 72 |
| 3576 | 3840 | 701038289H1 | SOYMON029 | g1263094 | BLASTN | 494 | 1e−31 | 75 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3577 | 3840 | 701212974H1 | SOYMON035 | g1263094 | BLASTN | 546 | 1e−36 | 74 |
| 3578 | 3840 | LIB3051-018-Q1-E1-G6 | LIB3051 | g1263094 | BLASTN | 899 | 1e−66 | 75 |
| 3579 | 3911 | 700684011H1 | SOYMON008 | g1749546 | BLASTN | 121 | 1e−22 | 58 |
| 3580 | 3911 | 700726126H1 | SOYMON009 | g1749546 | BLASTN | 138 | 1e−20 | 60 |
| 3581 | 3911 | 700734215H1 | SOYMON010 | g1749546 | BLASTN | 105 | 1e−23 | 51 |
| 3582 | 3911 | 700996059H1 | SOYMON018 | g1749546 | BLASTN | 122 | 1e−18 | 58 |
| 3583 | 3911 | 701014452H1 | SOYMON019 | g1749546 | BLASTN | 140 | 1e−22 | 55 |
| 3584 | 3911 | 701056116H1 | SOYMON032 | g1749546 | BLASTN | 141 | 1e−22 | 60 |
| 3585 | 3911 | 701121214H1 | SOYMON037 | g1749546 | BLASTN | 122 | 1e−18 | 51 |
| 3586 | 3911 | 701132709H1 | SOYMON038 | g1749546 | BLASTN | 122 | 1e−22 | 56 |
| 3587 | 3911 | LIB3049-052-Q1-E1-E7 | LIB3049 | g1749546 | BLASTN | 82 | 1e−35 | 60 |
| 3588 | 3926 | 700837867H1 | SOYMON020 | g1619921 | BLASTN | 144 | 1e−21 | 63 |
| 3589 | 3926 | 700842078H1 | SOYMON020 | g1619921 | BLASTN | 212 | 1e−30 | 64 |
| 3590 | 3926 | 700843027H1 | SOYMON020 | g19488 | BLASTN | 170 | 1e−31 | 76 |
| 3591 | 3926 | 700843129H1 | SOYMON020 | g662930 | BLASTN | 113 | 1e−20 | 70 |
| 3592 | 3926 | 700853331H1 | SOYMON023 | g19487 | BLASTN | 521 | 1e−34 | 73 |
| 3593 | 3926 | 700907314H1 | SOYMON022 | g1619921 | BLASTN | 153 | 1e−25 | 58 |
| 3594 | 3926 | 700907613H1 | SOYMON022 | g2464881 | BLASTN | 101 | 1e−20 | 56 |
| 3595 | 3926 | 700967747H1 | SOYMON033 | g662931 | BLASTN | 631 | 1e−43 | 73 |
| 3596 | 3926 | 701042075H1 | SOYMON029 | g662931 | BLASTN | 456 | 1e−28 | 70 |
| 3597 | 3926 | LIB3049-034-Q1-E1-F3 | LIB3049 | g19488 | BLASTN | 161 | 1e−57 | 69 |
| 3598 | 3937 | 700658125H1 | SOYMON004 | g2104680 | BLASTN | 326 | 1e−25 | 80 |
| 3599 | 3937 | 700745125H1 | SOYMON013 | g2104680 | BLASTN | 330 | 1e−27 | 77 |
| 3600 | 3937 | 700748325H1 | SOYMON013 | g2104680 | BLASTN | 326 | 1e−22 | 81 |
| 3601 | 3937 | 700845251H1 | SOYMON021 | g2104681 | BLASTN | 102 | 1e−26 | 86 |
| 3602 | 3937 | 700851931H1 | SOYMON023 | g2104680 | BLASTN | 367 | 1e−21 | 73 |
| 3603 | 3937 | 700854081H1 | SOYMON023 | g2104680 | BLASTN | 542 | 1e−36 | 75 |
| 3604 | 3937 | 700944587H1 | SOYMON024 | g2104680 | BLASTN | 644 | 1e−44 | 82 |
| 3605 | 3937 | LIB3049-006-Q1-E1-E8 | LIB3049 | g2104680 | BLASTN | 919 | 1e−73 | 80 |
| 3606 | 3937 | LIB3053-002-Q1-B1-F2 | LIB3053 | g2104680 | BLASTN | 585 | 1e−62 | 78 |
| 3607 | 4122 | 700863730H1 | SOYMON016 | g2555018 | BLASTN | 108 | 1e−18 | 31 |
| 3608 | 419 | 700554553H1 | SOYMON001 | g556557 | BLASTN | 434 | 1e−25 | 81 |
| 3609 | 419 | 700562907H1 | SOYMON002 | g556557 | BLASTN | 915 | 1e−67 | 82 |
| 3610 | 419 | 700669631H1 | SOYMON006 | g556557 | BLASTN | 850 | 1e−62 | 83 |
| 3611 | 419 | 700669949H1 | SOYMON006 | g556557 | BLASTN | 850 | 1e−62 | 83 |
| 3612 | 419 | 700681868H1 | SOYMON008 | g556557 | BLASTN | 912 | 1e−67 | 85 |
| 3613 | 419 | 700683342H1 | SOYMON008 | g556557 | BLASTN | 656 | 1e−45 | 82 |
| 3614 | 419 | 700685678H1 | SOYMON008 | g556557 | BLASTN | 663 | 1e−46 | 82 |
| 3615 | 419 | 700758063H1 | SOYMON015 | g556557 | BLASTN | 922 | 1e−68 | 84 |
| 3616 | 419 | 700795941H1 | SOYMON017 | g556557 | BLASTN | 354 | 1e−54 | 82 |
| 3617 | 419 | 701043342H1 | SOYMON032 | g556557 | BLASTN | 672 | 1e−47 | 81 |
| 3618 | 419 | 701044487H1 | SOYMON032 | g556557 | BLASTN | 693 | 1e−48 | 83 |
| 3619 | 419 | 701118765H1 | SOYMON037 | g556557 | BLASTN | 959 | 1e−71 | 83 |
| 3620 | 419 | LIB3051-047-Q1-K1-D7 | LIB3051 | g556557 | BLASTN | 1241 | 1e−94 | 82 |
| 3621 | 419 | LIB3073-013-Q1-K1-D3 | LIB3073 | g556557 | BLASTN | 442 | 1e−25 | 82 |
| 3622 | 4212 | 701150507H1 | SOYMON031 | g1181264 | BLASTN | 235 | 1e−08 | 61 |
| 3623 | 4509 | 700835337H1 | SOYMON019 | g1763063 | BLASTN | 125 | 1e−22 | 93 |
| 3624 | 4509 | 700865469H1 | SOYMON016 | g1763063 | BLASTN | 171 | 1e−25 | 66 |
| 3625 | 4509 | 700906733H1 | SOYMON022 | g1763063 | BLASTN | 95 | 1e−22 | 89 |
| 3626 | 4509 | 701117825H2 | SOYMON037 | g1763063 | BLASTN | 147 | 1e−25 | 94 |
| 3627 | 4513 | 700833937H1 | SOYMON019 | g171854 | BLASTN | 118 | 1e−25 | 39 |
| 3628 | 4513 | 700863780H1 | SOYMON016 | g171854 | BLASTN | 127 | 1e−25 | 38 |
| 3629 | 4533 | 700730794H1 | SOYMON009 | g1850792 | BLASTN | 353 | 1e−39 | 81 |
| 3630 | 4533 | 700742725H1 | SOYMON012 | g1850792 | BLASTN | 305 | 1e−16 | 82 |
| 3631 | 4533 | 700749727H1 | SOYMON013 | g1850792 | BLASTN | 504 | 1e−59 | 84 |
| 3632 | 4533 | 700789503H2 | SOYMON011 | g1850792 | BLASTN | 355 | 1e−48 | 81 |
| 3633 | 4533 | 700848536H1 | SOYMON021 | g1850792 | BLASTN | 465 | 1e−29 | 84 |
| 3634 | 4533 | 700888137H1 | SOYMON024 | g1850792 | BLASTN | 327 | 1e−16 | 86 |
| 3635 | 4533 | 700889876H1 | SOYMON024 | g1850792 | BLASTN | 314 | 1e−15 | 84 |
| 3636 | 4533 | 700893009H1 | SOYMON024 | g1850792 | BLASTN | 504 | 1e−33 | 83 |
| 3637 | 4533 | 700944604H1 | SOYMON024 | g1850792 | BLASTN | 465 | 1e−29 | 80 |
| 3638 | 4533 | 700952210H1 | SOYMON022 | g1850792 | BLASTN | 507 | 1e−33 | 84 |
| 3639 | 4533 | 700955405H1 | SOYMON022 | g1850792 | BLASTN | 507 | 1e−33 | 84 |
| 3640 | 4533 | 700956625H1 | SOYMON022 | g1850792 | BLASTN | 399 | 1e−22 | 83 |
| 3641 | 4533 | 701004730H1 | SOYMON019 | g1850792 | BLASTN | 507 | 1e−33 | 84 |
| 3642 | 4533 | 701004762H1 | SOYMON019 | g1850792 | BLASTN | 500 | 1e−32 | 83 |
| 3643 | 4533 | 701008170H1 | SOYMON019 | g1850792 | BLASTN | 507 | 1e−48 | 83 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3644 | 4533 | 701058588H1 | SOYMON033 | g1850792 | BLASTN | 493 | 1e−31 | 82 |
| 3645 | 4533 | 701130254H1 | SOYMON037 | g1850792 | BLASTN | 427 | 1e−55 | 84 |
| 3646 | 4533 | 701131239H1 | SOYMON038 | g1850792 | BLASTN | 455 | 1e−27 | 84 |
| 3647 | 4533 | 701135205H1 | SOYMON038 | g1850792 | BLASTN | 507 | 1e−33 | 84 |
| 3648 | 4533 | 701136840H1 | SOYMON038 | g1850792 | BLASTN | 385 | 1e−21 | 85 |
| 3649 | 4533 | 701141535H1 | SOYMON038 | g1850792 | BLASTN | 498 | 1e−32 | 83 |
| 3650 | 4533 | 701142624H1 | SOYMON038 | g1850792 | BLASTN | 455 | 1e−28 | 84 |
| 3651 | 4533 | 701143656H1 | SOYMON038 | g1850792 | BLASTN | 504 | 1e−64 | 83 |
| 3652 | 4533 | 701144723H1 | SOYMON031 | g1850792 | BLASTN | 407 | 1e−46 | 83 |
| 3653 | 4533 | 701146448H1 | SOYMON031 | g1850792 | BLASTN | 258 | 1e−10 | 83 |
| 3654 | 4533 | 701148343H1 | SOYMON031 | g1850792 | BLASTN | 507 | 1e−54 | 84 |
| 3655 | 4533 | 701148621H1 | SOYMON031 | g1850792 | BLASTN | 507 | 1e−57 | 84 |
| 3656 | 4533 | LIB3028-007-Q1-B1-D7 | LIB3028 | g1850792 | BLASTN | 507 | 1e−31 | 84 |
| 3657 | 4533 | LIB3050-002-Q1-E1-G12 | LIB3050 | g1850792 | BLASTN | 504 | 1e−84 | 82 |
| 3658 | 4546 | 700894637H1 | SOYMON024 | g1429228 | BLASTN | 124 | 1e−20 | 77 |
| 3659 | 4546 | 701036956H1 | SOYMON029 | g2826881 | BLASTN | 525 | 1e−35 | 83 |
| 3660 | 4546 | 701041532H1 | SOYMON029 | g2826882 | BLASTN | 174 | 1e−31 | 95 |
| 3661 | 4796 | 700652920H1 | SOYMON003 | g2104680 | BLASTN | 777 | 1e−62 | 76 |
| 3662 | 4796 | 700663404H1 | SOYMON005 | g2104680 | BLASTN | 262 | 1e−20 | 69 |
| 3663 | 4796 | 700807535H1 | SOYMON016 | g2104680 | BLASTN | 330 | 1e−33 | 67 |
| 3664 | 4796 | 700847547H1 | SOYMON021 | g2104680 | BLASTN | 498 | 1e−32 | 82 |
| 3665 | 4796 | 700851708H1 | SOYMON023 | g2104680 | BLASTN | 646 | 1e−45 | 83 |
| 3666 | 4796 | 700961790H1 | SOYMON022 | g2104680 | BLASTN | 297 | 1e−34 | 72 |
| 3667 | 4796 | 700970350H1 | SOYMON005 | g2104681 | BLASTN | 56 | 1e−19 | 75 |
| 3668 | 4796 | 701038462H1 | SOYMON029 | g2104680 | BLASTN | 273 | 1e−29 | 71 |
| 3669 | 4796 | 701039421H1 | SOYMON029 | g2104680 | BLASTN | 160 | 1e−28 | 80 |
| 3670 | 4796 | 701051129H1 | SOYMON032 | g2104680 | BLASTN | 322 | 1e−45 | 80 |
| 3671 | 4796 | 701154317H1 | SOYMON031 | g2104681 | BLASTN | 167 | 1e−27 | 81 |
| 3672 | 4796 | LIB3028-007-Q1-B1-B1 | LIB3028 | g2104680 | BLASTN | 497 | 1e−47 | 72 |
| 3673 | 4796 | LIB3049-038-Q1-E1-A10 | LIB3049 | g2104680 | BLASTN | 1009 | 1e−75 | 79 |
| 3674 | 4804 | 700733909H1 | SOYMON010 | g2104680 | BLASTN | 228 | 1e−30 | 81 |
| 3675 | 4804 | 700897635H1 | SOYMON027 | g2104680 | BLASTN | 262 | 1e−37 | 80 |
| 3676 | 513 | 700650723H1 | SOYMON003 | g1838975 | BLASTN | 644 | 1e−43 | 70 |
| 3677 | 5136 | 701050319H1 | SOYMON032 | g2244754 | BLASTN | 84 | 1e−21 | 49 |
| 3678 | 5194 | 700971432H1 | SOYMON005 | g2826881 | BLASTN | 511 | 1e−33 | 82 |
| 3679 | 5194 | 701046255H1 | SOYMON032 | g1429228 | BLASTN | 76 | 1e−17 | 100 |
| 3680 | 5194 | 701123541H1 | SOYMON037 | g2826881 | BLASTN | 424 | 1e−28 | 83 |
| 3681 | 5194 | 701211954H1 | SOYMON035 | g1429228 | BLASTN | 92 | 1e−31 | 71 |
| 3682 | 5194 | LIB3056-014-Q1-N1-E2 | LIB3056 | g2826881 | BLASTN | 1004 | 1e−75 | 80 |
| 3683 | 5288 | 700996065H1 | SOYMON018 | g19492 | BLASTN | 228 | 1e−37 | 67 |
| 3684 | 5288 | 700996241H1 | SOYMON018 | g19492 | BLASTN | 223 | 1e−32 | 62 |
| 3685 | 5288 | 700997432H1 | SOYMON018 | g662931 | BLASTN | 439 | 1e−27 | 70 |
| 3686 | 5448 | 700851939H1 | SOYMON023 | g2104682 | BLASTN | 441 | 1e−52 | 86 |
| 3687 | 5448 | 700852006H1 | SOYMON023 | g2104682 | BLASTN | 441 | 1e−52 | 86 |
| 3688 | 5448 | 700892455H1 | SOYMON024 | g2104682 | BLASTN | 447 | 1e−58 | 85 |
| 3689 | 555 | 700852179H1 | SOYMON023 | g2464855 | BLASTN | 188 | 1e−28 | 54 |
| 3690 | 555 | 700981245H1 | SOYMON009 | g2464855 | BLASTN | 175 | 1e−37 | 84 |
| 3691 | 555 | 700989616H1 | SOYMON011 | g2642435 | BLASTN | 209 | 1e−39 | 78 |
| 3692 | 555 | 701042926H1 | SOYMON029 | g2642435 | BLASTN | 196 | 1e−29 | 81 |
| 3693 | 5605 | 700548206H1 | SOYMON002 | g1763062 | BLASTN | 310 | 1e−26 | 73 |
| 3694 | 5605 | 700561956H1 | SOYMON002 | g1763062 | BLASTN | 155 | 1e−08 | 76 |
| 3695 | 5605 | 700755925H1 | SOYMON014 | g1763063 | BLASTN | 73 | 1e−21 | 87 |
| 3696 | 5605 | 700848126H1 | SOYMON021 | g1763062 | BLASTN | 353 | 1e−34 | 80 |
| 3697 | 5605 | 700865221H1 | SOYMON016 | g1763063 | BLASTN | 79 | 1e−31 | 77 |
| 3698 | 5605 | 700995194H1 | SOYMON011 | g1763062 | BLASTN | 317 | 1e−30 | 86 |
| 3699 | 5605 | 701011881H1 | SOYMON019 | g1763062 | BLASTN | 169 | 1e−11 | 79 |
| 3700 | 5605 | 701041839H1 | SOYMON029 | g1763063 | BLASTN | 58 | 1e−18 | 79 |
| 3701 | 5605 | LIB3049-006-Q1-E1-B5 | LIB3049 | g1763063 | BLASTN | 86 | 1e−49 | 78 |
| 3702 | 5605 | LIB3049-045-Q1-E1-E10 | LIB3049 | g1763063 | BLASTN | 86 | 1e−41 | 80 |
| 3703 | 5605 | LIB3055-002-Q1-B1-F6 | LIB3055 | g1763062 | BLASTN | 223 | 1e−28 | 79 |
| 3704 | 5605 | LIB3055-007-Q1-N1-B11 | LIB3055 | g1763062 | BLASTN | 310 | 1e−39 | 80 |
| 3705 | 5605 | LIB3056-008-Q1-N1-F9 | LIB3056 | g1763062 | BLASTN | 223 | 1e−29 | 78 |
| 3706 | 5605 | LIB3056-003-Q1-N1-A8 | LIB3056 | g1763062 | BLASTN | 353 | 1e−44 | 83 |

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3707 | 5605 | LIB3050-008-Q1-E1-D6 | LIB3050 | g1763063 | BLASTN | 86 | 1e−48 | 77 |
| 3708 | 5605 | LIB3050-022-Q1-K1-G11 | LIB3050 | g1763063 | BLASTN | 86 | 1e−47 | 78 |
| 3709 | 5605 | LIB3053-011-Q1-N1-E3 | LIB3053 | g1763063 | BLASTN | 86 | 1e−47 | 75 |
| 3710 | 5605 | LIB3053-011-Q1-N1-E7 | LIB3053 | g1763063 | BLASTN | 78 | 1e−35 | 85 |
| 3711 | 5605 | LIB3053-010-Q1-N1-B1 | LIB3053 | g1763062 | BLASTN | 346 | 1e−30 | 81 |
| 3712 | 570 | 700846492H1 | SOYMON021 | g2062176 | BLASTN | 179 | 1e−26 | 86 |
| 3713 | 570 | 700894740H1 | SOYMON024 | g2062176 | BLASTN | 191 | 1e−28 | 86 |
| 3714 | 5922 | 700565484H1 | SOYMON002 | g1899058 | BLASTN | 144 | 1e−22 | 77 |
| 3715 | 5922 | 700868485H1 | SOYMON016 | g1899058 | BLASTN | 116 | 1e−18 | 83 |
| 3716 | 5922 | 700943237H1 | SOYMON024 | g1899058 | BLASTN | 155 | 1e−23 | 71 |
| 3717 | 5961 | 700763147H1 | SOYMON015 | g671868 | BLASTN | 110 | 1e−18 | 69 |
| 3718 | 5961 | 700909837H1 | SOYMON022 | g2244754 | BLASTN | 145 | 1e−21 | 75 |
| 3719 | 6220 | 700660806H1 | SOYMON005 | g662930 | BLASTN | 116 | 1e−25 | 60 |
| 3720 | 6220 | 700901135H1 | SOYMON027 | g662930 | BLASTN | 186 | 1e−27 | 73 |
| 3721 | 6557 | 701068369H1 | SOYMON034 | g1101770 | BLASTN | 326 | 1e−46 | 70 |
| 3722 | 697 | 701059577H1 | SOYMON033 | g1292897 | BLASTN | 431 | 1e−25 | 63 |
| 3723 | 7166 | 701135334H1 | SOYMON038 | g414117 | BLASTN | 81 | 1e−19 | 66 |
| 3724 | 7236 | 700658905H1 | SOYMON004 | g1922964 | BLASTN | 233 | 1e−58 | 83 |
| 3725 | 7292 | 700556612H1 | SOYMON001 | g662923 | BLASTN | 281 | 1e−29 | 80 |
| 3726 | 7292 | 700675424H1 | SOYMON007 | g662924 | BLASTN | 148 | 1e−24 | 85 |
| 3727 | 7586 | 700672319H1 | SOYMON006 | g1101770 | BLASTN | 250 | 1e−36 | 74 |
| 3728 | 7586 | 700672929H1 | SOYMON006 | g1732246 | BLASTN | 515 | 1e−34 | 71 |
| 3729 | 7586 | LIB3052-001-Q1-B1-H7 | LIB3052 | g1101769 | BLASTN | 453 | 1e−43 | 74 |
| 3730 | 7592 | 700678729H1 | SOYMON007 | g458966 | BLASTN | 304 | 1e−43 | 62 |
| 3731 | 7592 | 700831110H1 | SOYMON019 | g458966 | BLASTN | 246 | 1e−35 | 56 |
| 3732 | 7804 | 700756020H1 | SOYMON014 | g2104680 | BLASTN | 273 | 1e−22 | 68 |
| 3733 | 7804 | 700970227H1 | SOYMON005 | g2104680 | BLASTN | 317 | 1e−15 | 59 |
| 3734 | 7804 | 700974028H1 | SOYMON005 | g2104680 | BLASTN | 266 | 1e−11 | 63 |
| 3735 | 7950 | 700729027H1 | SOYMON009 | g1945282 | BLASTN | 666 | 1e−46 | 77 |
| 3736 | 8078 | 700666305H1 | SOYMON005 | g2104680 | BLASTN | 859 | 1e−62 | 79 |
| 3737 | 8078 | 700791826H1 | SOYMON011 | g2104680 | BLASTN | 396 | 1e−45 | 75 |
| 3738 | 8078 | 700987478H1 | SOYMON009 | g2104680 | BLASTN | 778 | 1e−56 | 77 |
| 3739 | 8078 | 701056185H1 | SOYMON032 | g2104680 | BLASTN | 315 | 1e−15 | 62 |
| 3740 | 8078 | 701129761H1 | SOYMON037 | g2104680 | BLASTN | 646 | 1e−45 | 79 |
| 3741 | 82 | 700673133H1 | SOYMON006 | g1430847 | BLASTN | 921 | 1e−67 | 82 |
| 3742 | 82 | 700891441H1 | SOYMON024 | g1430847 | BLASTN | 788 | 1e−56 | 79 |
| 3743 | 82 | 700975491H1 | SOYMON009 | g1945281 | BLASTN | 139 | 1e−21 | 96 |
| 3744 | 82 | 700980383H1 | SOYMON009 | g1945281 | BLASTN | 133 | 1e−20 | 91 |
| 3745 | 82 | 701044378H1 | SOYMON032 | g1945281 | BLASTN | 115 | 1e−17 | 67 |
| 3746 | 82 | 701047753H1 | SOYMON032 | g1945281 | BLASTN | 197 | 1e−29 | 97 |
| 3747 | 82 | 701048272H1 | SOYMON032 | g1945281 | BLASTN | 147 | 1e−22 | 96 |
| 3748 | 82 | 701048288H1 | SOYMON032 | g1945281 | BLASTN | 147 | 1e−22 | 96 |
| 3749 | 82 | LIB3051-002-Q1-E1-D7 | LIB3051 | g1945281 | BLASTN | 167 | 1e−46 | 80 |
| 3750 | 82 | LIB3051-039-Q1-K1-G12 | LIB3051 | g928929 | BLASTN | 907 | 1e−66 | 81 |
| 3751 | 82 | LIB3051-084-Q1-K1-A12 | LIB3051 | g928929 | BLASTN | 955 | 1e−70 | 81 |
| 3752 | 8242 | 700562978H1 | SOYMON002 | g1763062 | BLASTN | 1045 | 1e−83 | 100 |
| 3753 | 8242 | 700654577H1 | SOYMON004 | g1763062 | BLASTN | 466 | 1e−52 | 89 |
| 3754 | 8242 | 700683276H1 | SOYMON008 | g1763062 | BLASTN | 843 | 1e−74 | 96 |
| 3755 | 8242 | 700761189H1 | SOYMON015 | g1763062 | BLASTN | 474 | 1e−53 | 92 |
| 3756 | 8242 | 700790555H2 | SOYMON011 | g1763062 | BLASTN | 1090 | 1e−82 | 100 |
| 3757 | 8242 | 700793624H1 | SOYMON017 | g1763062 | BLASTN | 692 | 1e−93 | 97 |
| 3758 | 8242 | 700797306H1 | SOYMON017 | g1763062 | BLASTN | 964 | 1e−71 | 94 |
| 3759 | 8242 | 700831193H1 | SOYMON019 | g1763062 | BLASTN | 970 | 1e−78 | 100 |
| 3760 | 8242 | 700852349H1 | SOYMON023 | g1763062 | BLASTN | 478 | 1e−50 | 92 |
| 3761 | 8242 | 700864869H1 | SOYMON016 | g1763062 | BLASTN | 764 | 1e−68 | 98 |
| 3762 | 8242 | 700865296H1 | SOYMON016 | g1763062 | BLASTN | 1006 | 1e−103 | 98 |
| 3763 | 8242 | 700869542H1 | SOYMON016 | g1763062 | BLASTN | 1110 | 1e−83 | 100 |
| 3764 | 8242 | 700873873H1 | SOYMON018 | g1763062 | BLASTN | 464 | 1e−64 | 92 |
| 3765 | 8242 | 700992121H1 | SOYMON011 | g1763062 | BLASTN | 549 | 1e−74 | 96 |
| 3766 | 8242 | 701001463H1 | SOYMON018 | g1763062 | BLASTN | 686 | 1e−87 | 100 |
| 3767 | 8242 | 701009789H1 | SOYMON019 | g1763062 | BLASTN | 547 | 1e−70 | 97 |
| 3768 | 8242 | 701012778H1 | SOYMON019 | g1763062 | BLASTN | 460 | 1e−52 | 91 |
| 3769 | 8242 | 701042608H1 | SOYMON029 | g1763062 | BLASTN | 1190 | 1e−90 | 100 |
| 3770 | 8242 | 701048487H1 | SOYMON032 | g1763062 | BLASTN | 474 | 1e−53 | 92 |
| 3771 | 8242 | 701050227H1 | SOYMON032 | g1763062 | BLASTN | 1145 | 1e−86 | 100 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3772 | 8242 | 701053639H1 | SOYMON032 | g1763062 | BLASTN | 371 | 1e−34 | 81 |
| 3773 | 8242 | 701123790H1 | SOYMON037 | g1763062 | BLASTN | 391 | 1e−74 | 92 |
| 3774 | 8242 | LIB3054-010-Q1-N1-F2 | LIB3054 | g1763062 | BLASTN | 549 | 1e−96 | 90 |
| 3775 | 8242 | LIB3056-014-Q1-N1-G11 | LIB3056 | g1763062 | BLASTN | 474 | 1e−71 | 89 |
| 3776 | 8242 | LIB3056-003-Q1-N1-H1 | LIB3056 | g1763062 | BLASTN | 1260 | 1e−131 | 93 |
| 3777 | 8317 | 700561923H1 | SOYMON002 | g2642435 | BLASTN | 131 | 1e−20 | 74 |
| 3778 | 8317 | 700892106H1 | SOYMON024 | g2642435 | BLASTN | 164 | 1e−24 | 73 |
| 3779 | 8317 | 700899889H1 | SOYMON027 | g2642435 | BLASTN | 213 | 1e−31 | 77 |
| 3780 | 8317 | 701003333H1 | SOYMON019 | g2642435 | BLASTN | 241 | 1e−35 | 78 |
| 3781 | 8317 | 701005077H1 | SOYMON019 | g2642435 | BLASTN | 155 | 1e−27 | 70 |
| 3782 | 8317 | 701010881H1 | SOYMON019 | g2642435 | BLASTN | 67 | 1e−17 | 77 |
| 3783 | 8317 | 701039015H1 | SOYMON029 | g1263097 | BLASTN | 217 | 1e−31 | 76 |
| 3784 | 8382 | 700560421H1 | SOYMON001 | g1899058 | BLASTN | 171 | 1e−30 | 68 |
| 3785 | 8382 | 701006630H1 | SOYMON019 | g1899058 | BLASTN | 155 | 1e−23 | 70 |
| 3786 | 8382 | 701010436H1 | SOYMON019 | g1899058 | BLASTN | 166 | 1e−24 | 69 |
| 3787 | 8382 | 701014821H1 | SOYMON019 | g1899058 | BLASTN | 165 | 1e−27 | 68 |
| 3788 | 8418 | 700560620H1 | SOYMON001 | g2832616 | BLASTN | 113 | 1e−22 | 46 |
| 3789 | 8418 | 700874673H1 | SOYMON018 | g2832616 | BLASTN | 83 | 1e−20 | 49 |
| 3790 | 8536 | 700564124H1 | SOYMON002 | g1263094 | BLASTN | 481 | 1e−31 | 74 |
| 3791 | 8536 | 700565513H1 | SOYMON002 | g1263095 | BLASTN | 243 | 1e−39 | 83 |
| 3792 | 8536 | 700849213H1 | SOYMON021 | g1263094 | BLASTN | 480 | 1e−30 | 75 |
| 3793 | 8536 | 700876718H1 | SOYMON018 | g1263094 | BLASTN | 453 | 1e−27 | 73 |
| 3794 | 8536 | 700891266H1 | SOYMON024 | g1263095 | BLASTN | 152 | 1e−38 | 85 |
| 3795 | 8536 | 700976667H1 | SOYMON009 | g1263094 | BLASTN | 452 | 1e−27 | 76 |
| 3796 | 8536 | 701013001H1 | SOYMON019 | g1263094 | BLASTN | 551 | 1e−37 | 74 |
| 3797 | 8536 | 701124025H1 | SOYMON037 | g1263094 | BLASTN | 485 | 1e−30 | 74 |
| 3798 | 8536 | 701206455H1 | SOYMON035 | g2642435 | BLASTN | 262 | 1e−38 | 83 |
| 3799 | 8766 | 700685146H1 | SOYMON008 | g22379 | BLASTN | 427 | 1e−31 | 82 |
| 3800 | 8766 | 700895522H1 | SOYMON027 | g22379 | BLASTN | 387 | 1e−22 | 81 |
| 3801 | 8766 | 700977785H1 | SOYMON009 | g22379 | BLASTN | 387 | 1e−35 | 81 |
| 3802 | 8766 | 701009551H1 | SOYMON019 | g22379 | BLASTN | 474 | 1e−29 | 76 |
| 3803 | 8766 | 701009560H1 | SOYMON019 | g22379 | BLASTN | 392 | 1e−22 | 81 |
| 3804 | 8793 | 700904667H1 | SOYMON022 | g1841474 | BLASTN | 746 | 1e−53 | 83 |
| 3805 | 8793 | 700904677H1 | SOYMON022 | g1841474 | BLASTN | 848 | 1e−61 | 84 |
| 3806 | 8793 | 700955479H1 | SOYMON022 | g1841474 | BLASTN | 496 | 1e−64 | 83 |
| 3807 | 8793 | 700958582H1 | SOYMON022 | g1841474 | BLASTN | 729 | 1e−52 | 80 |
| 3808 | 8793 | 700961381H1 | SOYMON022 | g1841474 | BLASTN | 838 | 1e−61 | 85 |
| 3809 | 8793 | 700964029H1 | SOYMON022 | g1841474 | BLASTN | 881 | 1e−64 | 86 |
| 3810 | 8793 | LIB3028-006-Q1-B1-A8 | LIB3028 | g1841474 | BLASTN | 1207 | 1e−92 | 84 |
| 3811 | 897 | 700686620H1 | SOYMON008 | g790635 | BLASTN | 144 | 1e−21 | 83 |
| 3812 | 897 | 700741338H1 | SOYMON012 | g790635 | BLASTN | 112 | 1e−17 | 74 |
| 3813 | 8985 | 700894021H1 | SOYMON024 | g171580 | BLASTN | 152 | 1e−25 | 47 |
| 3814 | 8985 | 700894303H1 | SOYMON024 | g171580 | BLASTN | 177 | 1e−26 | 49 |
| 3815 | 9000 | 700897913H1 | SOYMON027 | g1206002 | BLASTN | 736 | 1e−52 | 84 |
| 3816 | 9000 | 700899221H1 | SOYMON027 | g1206002 | BLASTN | 779 | 1e−56 | 84 |
| 3817 | 9000 | 700979179H1 | SOYMON009 | g1206002 | BLASTN | 452 | 1e−46 | 87 |
| 3818 | 9000 | 701150426H1 | SOYMON031 | g1206002 | BLASTN | 909 | 1e−67 | 87 |
| 3819 | 9000 | 701150655H1 | SOYMON031 | g1206002 | BLASTN | 495 | 1e−32 | 79 |
| 3820 | 9000 | 701154351H1 | SOYMON031 | g1206002 | BLASTN | 840 | 1e−61 | 84 |
| 3821 | 9000 | 701154756H1 | SOYMON031 | g1206002 | BLASTN | 786 | 1e−56 | 83 |
| 3822 | 9293 | 700754809H1 | SOYMON014 | g2062176 | BLASTN | 134 | 1e−20 | 92 |
| 3823 | 9293 | 700909018H1 | SOYMON022 | g2062176 | BLASTN | 134 | 1e−20 | 92 |
| 3824 | 9293 | 701106927H1 | SOYMON036 | g2062176 | BLASTN | 134 | 1e−20 | 92 |
| 3825 | 9293 | 701126505H1 | SOYMON037 | g2062176 | BLASTN | 104 | 1e−22 | 74 |
| 3826 | 9293 | LIB3051-107-Q1-K1-C1 | LIB3051 | g2062176 | BLASTN | 105 | 1e−52 | 65 |
| 3827 | 9376 | 700831926H1 | SOYMON019 | g695690 | BLASTN | 126 | 1e−19 | 46 |
| 3828 | 9376 | 701213194H1 | SOYMON035 | g695690 | BLASTN | 122 | 1e−18 | 46 |
| 3829 | 9561 | 700665919H1 | SOYMON005 | g1046277 | BLASTN | 254 | 1e−22 | 79 |
| 3830 | 9561 | 700842724H1 | SOYMON020 | g1046277 | BLASTN | 254 | 1e−15 | 88 |
| 3831 | 9795 | 700952349H1 | SOYMON022 | g1841474 | BLASTN | 994 | 1e−82 | 91 |
| 3832 | 9795 | 700956022H1 | SOYMON022 | g1841474 | BLASTN | 887 | 1e−73 | 90 |
| 3833 | 9795 | 700958780H1 | SOYMON022 | g1841474 | BLASTN | 501 | 1e−65 | 87 |
| 3834 | 9795 | 700959106H1 | SOYMON022 | g1841474 | BLASTN | 928 | 1e−68 | 89 |
| 3835 | 9795 | 700960315H1 | SOYMON022 | g1841474 | BLASTN | 897 | 1e−73 | 90 |
| 3836 | 9795 | 700960664H1 | SOYMON022 | g1841474 | BLASTN | 678 | 1e−51 | 90 |
| 3837 | 9802 | 700953222H1 | SOYMON022 | g166591 | BLASTN | 116 | 1e−25 | 50 |
| 3838 | 9802 | 700959943H1 | SOYMON022 | g1206002 | BLASTN | 405 | 1e−23 | 70 |
| 3839 | 9802 | 701205476H1 | SOYMON035 | g166589 | BLASTN | 432 | 1e−25 | 77 |
| 3840 | 9916 | 700667883H1 | SOYMON006 | g290056 | BLASTN | 611 | 1e−42 | 72 |

-continued

SOYBEAN OTHER TRANSCRIPTION FACTORS

| Seq No. | Cluster ID | CloneID | Library | NCBI gi | METHOD | Score | P-Value | % Ident |
|---|---|---|---|---|---|---|---|---|
| 3841 | 9916 | 700731014H1 | SOYMON009 | g290056 | BLASTN | 673 | 1e−47 | 74 |
| 3842 | 9916 | 700740852H1 | SOYMON012 | g290056 | BLASTN | 717 | 1e−50 | 73 |
| 3843 | 9916 | 701040044H1 | SOYMON029 | g290057 | BLASTN | 160 | 1e−27 | 81 |
| 3844 | 9916 | 701052544H1 | SOYMON032 | g290056 | BLASTN | 768 | 1e−55 | 80 |
| 3845 | 9916 | 701052934H1 | SOYMON032 | g290056 | BLASTN | 702 | 1e−49 | 72 |
| 3846 | 9916 | 701065663H1 | SOYMON034 | g172877 | BLASTN | 402 | 1e−51 | 77 |
| 3847 | 9916 | 701121723H1 | SOYMON037 | g290056 | BLASTN | 449 | 1e−35 | 69 |
| 3848 | 9916 | 701122023H1 | SOYMON037 | g290056 | BLASTN | 653 | 1e−45 | 72 |
| 3849 | 9916 | 701123218H1 | SOYMON037 | g290056 | BLASTN | 616 | 1e−42 | 72 |
| 3850 | 9916 | 701136006H1 | SOYMON038 | g290056 | BLASTN | 833 | 1e−60 | 79 |
| 3851 | 9916 | 701209561H1 | SOYMON035 | g290056 | BLASTN | 842 | 1e−61 | 78 |
| 3852 | 9916 | LIB3049-054-Q1-E1-C8 | LIB3049 | g2982330 | BLASTN | 993 | 1e−74 | 78 |
| 3853 | 9916 | LIB3052-012-Q1-N1-D8 | LIB3052 | g172877 | BLASTN | 721 | 1e−49 | 78 |

*Table Headings
Cluster ID
A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. The cluster ID entries in the table refer to the cluster with which the particular clone in each row is associated.
Clone ID
The clone ID number refers to the particular clone in the PhytoSeq database. Each clone ID entry in the table refers to the clone whose sequence is used for (1) the sequence comparison whose scores are presented and/or (2) assignment to the particular cluster which is presented. Note that a clone may be included in this table even if its sequence comparison scores fail to meet the minimum standards for similarity. In such a case, the clone is included due solely to itsassociation with a particular cluster for which sequences of one or more other member clones possess the required level of similarity.
Library
The library ID refers to the particular cDNA library from which a given clone is obtained. Each cDNA library is associated with the particular tissue(s), line(s) and developmental stage(s) from which it is isolated.
NCBI gi
Each sequence in the GenBank public database is arbitrarily assigned a unique NCBI gi (National Center for Biotechnology Information GenBank Identifier) number. In this table, the NCBI gi number which is associated (in the same row) with a given clone refers to the particular GenBank sequence which is used in the sequence comparison. This entry is omitted when a clone is included solely due to its association with a particular cluster.
Method
The entry in the "Method" column of the table refers to the type of BLAST search that is used for the sequence comparison. "CLUSTER" is entered when the sequence comparison scores for a given clone fail to meet the minimum values required for significant similarity. In such cases, the clone is listed in the table solely as a result of its association with a given cluster for which sequences of one or more other member clones possess the required level of similarity.
Score
Each entry in the "Score" column of the table refers to the BLAST score that is generated by sequence comparison of the designated clone with the designated GenBank sequence using the designated BLAST method. This entry is omitted when a clone is included solely due to its association with a particular cluster. If the program used to determine the hit is HMMSW then the score refers to HMMSW score.
P-Value
The entries in the P-Value column refer to the probability that such matches occur by chance.
% Ident
The entries in the "% Ident" column of the table refer to the percentage of identically matched nucleotides (or residues) that exist along the length of that portion of the sequences which is aligned by the BLAST comparison to generate the statistical scores presented. This entry is omitted when a clone is included solely due to its association with a particular cluster.

SEQUENCE LISTING (3853 sequences)

SEQ ID NO: 1 - DNA, 320 bp, Arabidopsis thaliana
cacacgcgtccgctcctccatatcttaacaatttcatagcaaaccctaaaattgagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatg

SEQ ID NO: 2 - DNA, 366 bp, Arabidopsis thaliana
acgcgtccgtggagaactcgttaactgcaaaagagaagattatttcggagcttaatatggagattcacaatgttgagacagctttagctaatgagcgagaaagtcatgttgccgagataaagaaattgaattctttgctcaataaaaaggatactatcattgaagagatgaagaaagagcttcaagaaagaccatcagcaaaattagttgatgatttgcgcaaaaaagtgaaaattctgcaggctgtaggttacaattcaattgaggctgaagactgggatgctgctaccactggtgaagagatgagcaaaatggagtcgcttcttcttgataaaaacagaaaaatggaacatgaggtcactcagt

SEQ ID NO: 3 - DNA, 402 bp, Arabidopsis thaliana
caaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaagaggtgaagattggcggagtgctagctataatgcggcgattttaagacatccgatgtac

SEQ ID NO: 4 - DNA, 364 bp, Arabidopsis thaliana
aagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatg

SEQ ID NO: 5 - DNA, 234 bp, Arabidopsis thaliana
aacccacgcgtccgatagtctttatagataagactcttcaacgattccactttatttttcggtgggattgttggttgatgaagaaaaaaaaatagtttgtaattacaggtttaaatatgtagagaaaaaatgacgaatatgtattatcttgtttttttttccttcgaatatgtattacggtaatataaatttgcttgtaaaaataataaatatattatttgataaattttgtac

SEQ ID NO: 6 - DNA, 409 bp, Arabidopsis thaliana
gttatggcctgttgggagattgaacagtcgcttcaaagttttacaggggtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctca

SEQ ID NO: 7 - DNA, 392 bp, Arabidopsis thaliana
tacggctgcgagaagacgacagaaggggagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgaga

SEQ ID NO: 8 - DNA, 391 bp, Arabidopsis thaliana
ggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatgtcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgtt

SEQ ID NO: 9 - DNA, 420 bp, Arabidopsis thaliana
cggacgcgtgggcaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcacggtgtctctctgctccgctccaatgcaatgaacgcgaatcagagtagtatgctaattcttca

SEQ ID NO: 10 - DNA, 426 bp, Arabidopsis thaliana
cgtaacataatcttccaaacttcaccagaagaaattcttaacatacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaacaaatttgccggcagacctcgtcccacagcggcatctcatctttctcgagcggaagggtaaagagagaaagagaaatctccgggggggatgggaaaaaagaggcgggagagaagacggat

SEQ ID NO: 11 - DNA, 417 bp, Arabidopsis thaliana
cccacgcgtccgcttaacaaacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcg

SEQ ID NO: 12 - DNA, 382 bp, Arabidopsis thaliana
acccacgcgtccgtcttaacaaacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaaaggtaaagagagaaagagaaatctccggcggcgatggagaaga

SEQ ID NO: 13 - DNA, 401 bp, Arabidopsis thaliana
cccacgcgtccggaagaatatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacattcaggagctgcgtcgtcttgaggatgaaa

SEQ ID NO: 14 - DNA, 425 bp, Arabidopsis thaliana
ggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacattcaggagctgcgtcgtcttgaggatgaaatggaaaacactttcaaactcgttcgcgagcgcaagttcaaatctc

SEQ ID NO: 15 - DNA, 360 bp, Arabidopsis thaliana
gaagaatatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacat

SEQ ID NO: 16 - DNA, 432 bp, Arabidopsis thaliana
cacacgcgtccgcccacgcgtccgcccacgcgtccgcaaagagagaagaatatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacattcaggagctgcgtcgtcttgaggatgaa

SEQ ID NO: 17 - DNA, 397 bp, Arabidopsis thaliana
gccaacatcacacaaacatagagattccaaaaaataaaaataaagaaaacataaatcctctgaggaaaaattccgatgagatgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctca

SEQ ID NO: 18 - DNA, 417 bp, Arabidopsis thaliana
taaaaataaagaaaacataaatcctctgaggaaaaattccgatgacatgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctcagttcgagtccttaaagaaagaaaaacaagctttagtctctgagaggctaaaaga

SEQ ID NO: 19 - DNA, 219 bp, Arabidopsis thaliana
agaaaacataaatcctctgaggaaaaattccgatgagatgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttca

SEQ ID NO: 20 - DNA, 453 bp, Arabidopsis thaliana
tacgactgcgagaagacgacagaaggggagagattccaaaaaataaaaataaagaaaacataaatcctctgaggaaaaattccgatgagatgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctcagttcgagtccttaaagaaagaaaaacaagctttagtctctgagttgc

SEQ ID NO: 21 - DNA, 410 bp, Arabidopsis thaliana
gaaaaactttcctaattggttcataccaaagtctgagctcttctttatatctctcttgtagtttcttattgggggtctttgttttgtttggttcttttagagtaagaagtttcttaaaaaaggatcaaaaatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataagggaaaactcttcgaatactccactgattcttgtatggagaagatacttgaacgcgatgagatgtactcttacgccgaaagacagcttattgcacctgagtccgacgtcaatacaaactggtcgatgg

SEQ ID NO: 22 - DNA, 355 bp, Arabidopsis thaliana
gcaaaaacagagtttttttttcttatcttgagaaagttcaacagaagatgatgttcgagaaagacgatctgggtctaagcttaggcttgaattttccaaagaaacagatcaatctcaaatcaaatccatctgtttctgttactccttcttcttcttcttttggattattcagaagatcttcatggaacgagagttttacttcttcagttccaaactcagattcgtcacaaaaagaaacaagaactttcatccgaggaatcgacgtgaacagaccacggtctacaagcggaatacgggaacaagaaccctggataacctcaactaacaattcaatcccaaactccaaaaggaaaag

SEQ ID NO: 23 - DNA, 387 bp, Arabidopsis thaliana
actctccctctctatctctctcttaccaatttccatttctcgggggaaaataataatacgacttttgaaatctctcactaatatttcccaagaaaacctgatgaattaaaagttcatattttcttggtgttgattggtattagatgactatttcttagtattagtcaattctctgtttccatcttatatggatagtctagacacagagcaaagatccttctttggagaaaaagaagatgagagacgagagaggatcgtttcttcacgtattggtcgtagatagatcttaatcgataaccatctaggccttgatctaaccattcaatataaactttatttccttcttcttttcgatctcaattgttccgaccaaacaagatgaagaga

SEQ ID NO: 24 - DNA, 399 bp, Arabidopsis thaliana
atctccctctctatctctctcttaccaatttccatttctcgggggaaaataataatacgacttttgaaatctctcactaatatttcccaagaaaacctgatgaattaaaagttcatattttcttggtgttgattggtattagatgactatttcttagtattagtcaattctctgtttccatcttatatggatagtctagacacagagcaaagatccttctttggagaaaaagaagatgagagacgagagaggatcgtttcttcacgtattggtcgtagatagatcttaatcgataaccatctaggccttgatctaaccattcaatataaactttatttccttcttcttttcgatctcaattggtccgaccaaacaagatgaagagatcacgtggaagct

SEQ ID NO: 25 - DNA, 393 bp, Arabidopsis thaliana
accacgcgtccgtgactatttcttagtattagtcaattctctgtttccatcttatatggatagtctagacacagagcagagatccttctttggagaaaaagaagatgagagacgagagaggatcgtttcttcacgtatgggtcgtagatagatcttaatcgataaccatctacgccttgatctaaccattcaatataaactttatttccttcttcttttcgatctcaattgttccgaccaaacaagatgaagagatcacgtgggagctccgattctttatccggtttcttaccaattcgccattctacaacagacaaacaaataagcccaagaccaacaactagcggctttctctattccggggccggagactactcccagatgtttgacgca

SEQ ID NO: 26 - DNA, 381 bp, Arabidopsis thaliana
ctccctctctatctctctcttaccaatttccatttctcgggggaaaataataatacgacttttgaaatctctcactaatatttcccaagaaaacctgatgaattaaaagttcatattttcttggtgttgattggtattagatgactatttcttagtattagtcaattctctgtttccatcttatatggatagtctagacacagagcaaagatccttctttggagaaaaagaagatgagagacgagagaggatcgtttcttcacgtattggtcgtagatagatcttaatcgataaccatctaggccttgatctaaccattcaatataaactttatttccttcttcttttcgatctcaattgttccgaccaaacaagattaag

SEQ ID NO: 27 - DNA, 390 bp, Arabidopsis thaliana
ctcttttggactttctcaatccatatccctctctctgttttttctaatttgagcctctaaagtctcctcgttttgttcatgttgttgttcaagtgaagaagctcaattatgtttacaacattgttgtaatttcaaaacttcataagaatttctctgataataaagaaaaagctggagtagaactattttaaagtgtcatcatgaagagactaagcagctcagattcaatgtgtggtctaatctccacttctacagatgaacagagtccaagagggtacggaagtaattaccaatctatgcttgaaggttacgatgaagatgctacactaatcgaggaatattccgggaaccaccaacacatgggtctatcggagaagaagagaagattaa

SEQ ID NO: 28 - DNA, 414 bp, Arabidopsis thaliana
ggactttctcaatccatatccctctctctgttttttctaatttgagcctctaaagtctcctcgttttgttcatgttgttgttcaagtgaagaagctcaattatgtttacaacattgttgtaatttcaaaacttcataagaatttctctgataataaagaaaaagctggagtagaactattttaaagtgtcatcatgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagtgaccaagtcaaagctcttgagaagaat

SEQ ID NO: 29 - DNA, 361 bp, Arabidopsis thaliana
atcaacctcaaaaatctctctcctctctctctctgtatatagaagaatctccattgtctttaatttctctccatttctctttctctcttccttcaaagttttctcttttcttgatgggtttaagagagtaaagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaagagatacggtgggagagaatttcagtcgatgcctgaaagataccaagaagaagaagaagctatagtagaagaaaga

SEQ ID NO: 30 - DNA, 382 bp, Arabidopsis thaliana
cgctcatcaacctcaacaatctctctcctctctctctctgtatatagaagaatctccattgtctttaatttctctccatttctctttctctcgtccttcagggttttctcttttcttgatgggtttaagagagtaaagatcatcaagtactatgcattaaattgagaggttattatcaatttcgaaagtgattaacgattgttgatgatgaagagattaagtagttcagattcagtgggtggtctcatctcgttatgtcctacaacttccatagatgagcagagtccgaggagatacggtgggagagagttgcagtcgatgcttgaacgatacgaggaagaagaagacgctatattagaagatagacgacacgtgggcttgt

SEQ ID NO: 31 - DNA, 449 bp, Arabidopsis thaliana
cgctcatcaacctcaacaatctctctcctctctctctctgtatatagaagaatctccattgtctttaatttctctccatttctctttctctcttccttcaaagttttctcttttcttgatgggtttaagagagtaaagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaaggaaagttaagcataaacaagttaaagctttggagaagaatttgagttagagaataa

SEQ ID NO: 32 - DNA, 386 bp, Arabidopsis thaliana
atcaacaatctctctcctctctctctctgtatatagaagaatctccattgtctttaatttctctccatttctctttctctcttccttcaaagttttctcttttcttgatgggtttaagagagtagagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtccggagaagaagaga

SEQ ID NO: 33 - DNA, 415 bp, Arabidopsis thaliana
caaacgcgtccgcgctcatcaacctcaacaatctctctcctctctctctctgtatatagaagaatctccattgtctttaatttctctccatttctctttctctcttccttcaaagttttctcttttcttgatgggtttaagagagtaaagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaagagaaggttaa

SEQ ID NO: 34 - DNA, 376 bp, Arabidopsis thaliana
accacgcatccgcaacctcaacaatctctctcctctctctctctgtatatagaagaatctccattgtctttaatttctctccatttctctttctctcttccttcaaagttttctcttttcttgatgggtttaagagagtaaagatcatcaagtactatgcattaaattgagaagttattaaaaatttcgaaagtaattaaagattgttgatgatgaagagattaagtagttcagattcagtgggtggtctcatctctttatgtcctaaaacttccacagatgagcagagtccgaggagatacggtgggagagagtttcagtcgatgcttgaaggatacgacgaagaagaagaagctatagtagaagaaagaagaca

SEQ ID NO: 35 - DNA, 438 bp, Arabidopsis thaliana
agggaaaacgctcatcaacctcaacaatctctctcctctctctctctgtatatagaagaatctccattgtctttaatttctctccatttctctttctctcttccttcaaagttttctcttttcttgatgggtttaagagagtaaagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaagagaaggttaagcattaaccaagttaaagctttggaga

SEQ ID NO: 36 - DNA, 344 bp, Arabidopsis thaliana
  unsure (1)..(344): unsure at all n locations
ctcttttcttgatgggtttaagagagtaaagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaggagatacggtgggagagagtttcagtcgatgcttgaaggatacgatgaagaagaagaagctatagtagaagaaagaggacacgtgggcttgtcggagaagaagatanaggttaagcattaacaagttaaagctttggagaagaattttgagttaggagaat

SEQ ID NO: 37 - DNA, 410 bp, Arabidopsis thaliana
cccacgcgtccggcaaaaacaaaaccaacaaggaacttgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatccaattcgtttttcttcgatccatctgcttcacacg

SEQ ID NO: 38 - DNA, 442 bp, Arabidopsis thaliana
agcccgcgcgtccgcccacgcgtccgcccacgcgtccgcccacgcgtccgctctgtttcctctttctctctgtttcctctttctcagaactcagaagtagttgttgttttatttctgttgatcaaaaatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacag

SEQ ID NO: 39 - DNA, 446 bp, Arabidopsis thaliana
  unsure (1)..(446): unsure at all n locations
tacggctgcgagaagacgatagaagggggagacgctcacattgcaaaaacaaaaccaacaaggaacttgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatcaaattcgttnttcntcgattcatctgcttcacacggcaaca

SEQ ID NO: 40 - DNA, 435 bp, Arabidopsis thaliana
tacagctgcgagacgacagaagggggagacgctcacattgcaaaaacaaaaccaacaaggaacttgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacagcttcttccgccataagatcatgatcttctaatccttcctacttcttcccatctttttaatcatcttctcgctatctctgcttcccctttctctctgtttcctctttctcagaactcagaagtagttgttgttttatttctgttgatcaaaaatggaatccaattcgtttttcttcgattcatccgcttcacac

SEQ ID NO: 41 - DNA, 268 bp, Arabidopsis thaliana
atccaaaagttcactgctgcaacattgaaacaaatacacagaaggagaacagattacaataatgatgtaagaaagatatataggtcttaggttctcttgacagggtcaaagttggagacgccgacgacgacaccaatgatgacagtgaggacgaggccaccagaagcaatgctgagcaagaaattcttgagggaatgagagattccacaaccaacagcttcagctatctccggaatcaccatcgaagcagtaatagcagccgcggaag

SEQ ID NO: 42 - DNA, 330 bp, Arabidopsis thaliana
gcggccgcccttttttttttttttttttttttttttttttttttttttttttttttttttttttttttttttttttttttttttttttttttttttgacatgttaaccccttcgcaatttccctttgatcggatgatcctaaattacaagaagtgcacaaaaatcactagagaaaaagcaaaattacaaattcacccgaaatcattattcccgcccagacttaacccttccttaattgccctttcacccttcaattttaactttattcccattttgcccccctcggttttttccacagagaggaacagagcatctaagcaaagccaaaag

SEQ ID NO: 43 - DNA, 452 bp, Arabidopsis thaliana
tacggctgcggaagacgacagaagggggtcaaggaggaagaagtttcgttgccggagaagattacagaggcaccgtcgtctcctccacagtttcttgaacattctgatggtcttaattaccggagtttcacagatctacgtgatcttcttccattaaaggcggcggcttcttcattcgccgccgcagctggatcttcagacagtagcgattcaagcgctctgctgaatgaagaaagcagctctaatgtcactgtggcggctccggtgacggttccaggaggtaatttcttccagtttgtgaaaatggagcagacggaggatcatgaggactttctgagtggagaagaagcttgtgaattcttttccgatgaacaaccgccgtctctacactggtactccaccgttgatcattggaattgaagctgaaaacaccaccggaagagattttggat

SEQ ID NO: 44 - DNA, 419 bp, Arabidopsis thaliana
cccacgcgtccgcccacgcgtccgtacggctgcgagaagacgcagaaggatgagttagagaataagcttgagcctgagaggaaagttaagttagctcaagaacttggtcttcaacctcgtcaagttgctgtttggtttcaaaaccgtcgtgctcggtggaagacaaaacagcttgagaaagattacggtgttcttaaaacccagtacgattctctccgtcataactttgattccctccgccgtgacaatgaatctctccttcaagagattagtaaactgaaaacgaagcttaatggaggaggaggagaagaagaagaagaagagaacaacgcggcggtgacaacggagagtgatatttcggtcaaggaggaagaagtttcgttgccggagaagattacagatgcaccgttgtctcctcc

SEQ ID NO: 45 - DNA, 410 bp, Arabidopsis thaliana
cccacgcgtccgcccacgcgtccgcccacgcgtccgcccacgcgtccgtacggctgcgagaagacgacagaatggtgagttagagaagaaacttgagcctgagaggaaagttcagttagctcaagaacttggtcttcaacctcgtcaagttgctgtctggtttcaaaaccgtcgtgctcggtggaagacagtacagcttgagaaagattacggtgttcttaaaacccagtacgattctctccgtcataactttgattctccccgccgtgacaatgaatcgcgccttcaagagattagtgaactgaagacgacgcttaatagaagaggagaagaagaagaagaagagaacagcgcggcagtgataacggagagtgagatctcggtcaatgaggaagacatttcgtttccgg

SEQ ID NO: 46 - DNA, 460 bp, Arabidopsis thaliana
  unsure (1)..(460): unsure at all n locations
cgagaagacgacagaaggggaaagaaaaaaaagaaacaaataattccaaaaccttctctcttaatcaaaatcaagaaacttacaagatctggtgaaaaccatggaagaaggagattttttcaactgctgtttcagcgagattagtagtggcatgaccatgaataagaagaagatgaagaagagcaataaccaaaagaggtttagcgaggaacagatcaagtcacttgagcttatatttgagtctgagacgaggcttgagccgaggaagaaggttcaggtagctagagagctanggctgcaaccaagacaagtggctatatggtttcaaaacaagaaggctcgatggaaaactaagcaacttgagaaagagttatacattcttaagagccaattacaacaatttggcttcacaatttgaaatcatgaagaaagaaaagcaatctctggtctctgagctgca

SEQ ID NO: 47 - DNA, 431 bp, Arabidopsis thaliana
tacaactgcgagaagacgacagaggggatatcaagaaaatgattaatagcactaaccatcagaggtttagcgaggaacacatcaagtcacttgagcttatatatgagtctgagacgatgcttgagccgaggaagaaggttcaggtagctaaagatctagggctgcaaccaatacaagtggctatatggtttcaaaacaagacggctcgatggaaaactacacaacttgagaaagagtataacactcttacagccagttacaacactttggcttcacaatttgaggtcatgaataaagtgaatcaatctctggtctctgagctgcagatactatacgaagatatgcacatgcctaaagaagaaaagcatcatgagtgttgtggtgatcaatgactggatctaagcatcagcacagagtctcataatggaaac

SEQ ID NO: 48 - DNA, 284 bp, Arabidopsis thaliana
tttaagaaaagtttctgtgtctttttttttttttttggtgataattgaaacatatgaaacaatcgtcgtcatagaagcagcagagattcaccttctttctttatctttccctctcagaaacaggaaacaaaattcaaaaagaacaaaaaaaaaaggtcaaaccaaaacgatggcgtttcatcacaatcatctctcacaagacctctccttcaatcatttcaccgaccaacaccaacctccacctccgcaaccgcctcctcctcctccgcaacagcaacaacatt

SEQ ID NO: 49 - DNA, 450 bp, Arabidopsis thaliana
cccacgcgtccgcccacgcgtccgcccacgcgtccgtacggctgcgagaagacgacagaagggtacggctgcgagaagacgacagaaggggaaaaagaacaaaaaaaaaaggtcaaaccaaaacgatggcgtttcatcacaatcatctctcacaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacaaagccaccgctaacaccacaaccgcaagcagttccgattttccttcctccgccgccgcccgcgccgctgctaaccagtggctatcctcgccctcctctttcctctaaccaaacaacaacaacaacg

SEQ ID NO: 50 - DNA, 457 bp, Arabidopsis thaliana
tttcactaaggaaaaggaatcagtttttggtggaagtaattgatccgatctaggaaaaatgggaggaggtgatcatggacatggagcagaaggaggcgatttcagagccaaagtctggagtatgactggtgggcctaactgtaggcccaaacattggcgtcggaacaccgccattgctatgttcggcgttttccttgtgtgcatccccatcgccaagctatctgctaagcttgagcaaaggccacacatgccagtacgcccaattccttcacagatctggtgcaagaactttggaaccaaggacgattacgaaaaagagcattaaaagtttttttcttggtttggagagaaccctttaattggtcttcttatttgcagacaatgtgagcataaaaaaagcgcttctagctttgtcaatggatttcagagtactgtgaacatactaatatgtcttttt

SEQ ID NO: 51 - DNA, 419 bp, Arabidopsis thaliana
  unsure (1)..(419): unsure at all n locations
gagagagatgggtgattctgacgtcggtgatcgtcttccccctccatcttcttccgacgaactctcgagctttctccgacagattctttcccgtactcctacagctcaaccttcttcaccaccgaagagtactaatgtttcctccgctgagaccttcttcccttccgtttccggcggagctgtttcttccgtcggttatggagtctctgaaactggccaagacaaatatgctttcgaacacaagagaagtggagctaaacagagaaattcgttgaagagaaacattgatgctcaattccacaacttgtctgaaaagaggaggagcaagatcaacgagaaaatgaaagctttgcagaaactcattcccaattccaacaagactggatanagctcaatgcttgatgaagctatagaatatc

SEQ ID NO: 52 - DNA, 420 bp, Arabidopsis thaliana
  unsure (1)..(420): unsure at all n locations
aaatattaaacttcggcgatgaaggtaaacgaagctccggaaacccggatccaagttcttattcgggtcaaacacaattcgaaaacaaaagaaagaggtcgatggttttgaacgaagataaagttctatcattcggagataaaaccgccggagaatcagatcactccgatctagaagcttccgtcgtgaaagaagtagcagtagagaaacgtccaaagaaacgaggaagaaagccagcaaacggtagagaagagccactaaaccacgtcgaagcagagagacaaagacgcgagaaactaaaccaaagattctacgcgttacgagcggtttgtacaaacgtttcaaaaatggataaagcttcgttactcggtgacgcaatcgcttacatcaacgagcttaaatcanagtagtcaaaacaga

SEQ ID NO: 53 - DNA, 407 bp, Arabidopsis thaliana
cccgaatctggatccgactccgagtccggttcattctcagacccagaatccgaaattcaataacactttctcccgagaacttaatttttcgacgtcaagttctactttagtgaaaccaagatccggcgagatattaaacttcggcgatgaaggtaaacgaagctccggaaacccggatccaagttcttattcgggtcaaacacaattcgaaaacaaaagaaagaggtcgatggttttgaacgaagataaagttctatcattcggagataaaaccgccggagaatcagatcactccgatctagaagcttccgtcgtgaaagaagtagcagtagagaaacgtccaaagaaacgaggaagaaagccagcaaaccgtagagaagagccactaaaccacgtcgaagcagaga

SEQ ID NO: 54 - DNA, 413 bp, Arabidopsis thaliana
  unsure (1)..(413): unsure at all n locations
aattttagtatgtctcaattgggtcagtcaaagtctccgtttttccaactcttcaagaggaagaaacaaggctctgctggttttgccgatagtatgttgaagcttgttaggactttgcctaaggttttgaagtacttacctagtgacaaggctcaagatgctcgtctctacatcttgagtttacagttttggcttggaggctctcctgataatcttcagaattttgttaagatgatttctggatcttatgttccggctttgaaaggtgtcaaaatcgagtattcggatccggttttgttcttggatactggaatttggcatccacttgctccaaccatgtacgatgatgtgaaggagtactggaactggtatgacactagaagggacnacaatgactcactcaagangaaaga

SEQ ID NO: 55 - DNA, 432 bp, Arabidopsis thaliana
  unsure (1)..(432): unsure at all n locations
cccacgcgtccggctgagtgtgttggaagggagatagaggatgtttacagaggaagcgacaagggtatcttgagcgatgtagagcttctcaaagagatcactgatgcctcacgtggcgctgtttccgcctttgtggaaaaaacaacaaatagcaaaggacaggtggtggatgtgtctgacaagcttacctcgcttcttgggtttggaatcaatgagccatgggttgagtatttgtccaacaccaagttctacagggcgaacagagataagctcagaacagtgtttggtttccttggagagtgcctgaagttggtggtcatggacaacgaactagggagtctaatgcaagctttggaaggcaagtacgtcgagcctggccccggaggtgattccatcagaaacccaaaggtctntacaaccggtaaaaacatc

SEQ ID NO: 56 - DNA, 376 bp, Arabidopsis thaliana
  unsure (1)..(376): unsure at all n locations
gtcagagaaactccaaatcaagaaccagctcgaggaagtgaaactcgagctcgccggaagaaaagcgagtgctagtggaggagatatgtcgtcttcgtgttcttcgattaaaccggtggggatggagattgaagtgaagataattggttgggacgcaatgattagagttgaatctagtaagaggaatcatccggcggcgaggttgatgtcggcgttgatggatttggagttggaagtgaatcacgcgagtatgtcggtggttaacgatttgatgattcaacaagcgacggtgaagatgggttttaggatctatacgcaagaacagctcagagcaagtttgatttcaaaaatcngttaaaagggtgtgttttgggga

SEQ ID NO: 57 - DNA, 171 bp, Arabidopsis thaliana
gtttgggatgcatactactgcgtgtattccttcggcgaacggagttgtggaagtcgggtcaacggagccgatccgacagagttcggaccttattaacaaggttcgaagtcatttcaatttcgaccgcggagctggagagttatcgggtcttaagtggaagcttgacccgga

SEQ ID NO: 58 - DNA, 364 bp, Arabidopsis thaliana
ctcactctctcattaaaaacgtgtttttttttaccggtcaccggtttatggaatgactgattaccggctacaaccaacgatgaatctttggaccaccgacgacaacgcttctatgatggaagctttcatgagctcttccgatatctcaactttatggcctccggcgtcgacgacaaccacgacggtgacgactgaaacaactccgacgccggcgatggagattccggcacatgcgggatttaatcaagagactcttcatcaacgtttacaagctttgattgaaggaacacacgaaggttggacctacgctatattctggcaaccgtcgtatgatttctccggcgcctccgtgctcggatgggga

SEQ ID NO: 59 - DNA, 210 bp, Arabidopsis thaliana
ctctcattaaaaacgtgtttttttttaccggtcaccggtttatggaatgactgattaccggctacaaccaacgatgaatctttggaccaccgacgacaacgcttctatgatggaagctttcatgagctcttccgatatctcaactttatggcctccggcgtcgacgacaaccacgacggcgacgactgaaacaactccgacgccggcgat

SEQ ID NO: 60 - DNA, 202 bp, Arabidopsis thaliana
aacgtttacacgctttgattgaaggaacacacgaaggttggacctacgctatattctggcaaccgtcgtatgatttctccggcgcctccgtgctcggatggggagatggttattacaaaggtgaagaagataaagcaaacccgagacggagatcgagttcgccgccgttttctactccggcggatcaggagtacaggaaaaa

SEQ ID NO: 61 - DNA, 422 bp, Arabidopsis thaliana
gcttgtgagcagagagagagagcgagcgaggaggctagagaatcgagaatcgatcttcgccgaaccaccttgtcttctcttagctcatcgaatctctccgtcgccgtcgattcttcccgccggtgaatctctgccttattgttttcttcaatttgatcgtcctgaattcatcgtcctatttagggtttcgatcacaatctgaagaggaggtcatggacgtttctgctagaaagtcacaaaaagctgggcgcgaaaagttgaggagggaaaaactgaatgagcattttgttgaactgggaaatgtactcgatccagagagacccaagaatgacaaagccacgattctgactgatactgttcagttgttgaaagagctcacatctgaagtcaacaaactgaaatctgagttacacgcattgaca

SEQ ID NO: 62 - DNA, 416 bp, Arabidopsis thaliana
ggaggctagagaatcgagaatcgatcttcgccgaaccaccttgtcttctcttagctcatcgaatctctccgtcgccgtcgattcttcccgccggtgaatctctgccttattgttttcttcaatttgatcgtcctgaattcatcgtcctatttaaggtttcgatcacaatctgaagaggatgtcatggacgtttctgctaaaaagtcacaaaaagctgggcgcgaaaagttgaggagggaaaaactgaatgagcattttgttgaactgggaaatgtactcgatccagagagacccaagaatgacaaagccacgattctgactgatactgttcagttgttgaaagagctcacatctgaagtcaacagactgaaatctgagtacaacgcattgacagatgagtcccgcgagttgacaca

SEQ ID NO: 63 - DNA, 424 bp, Arabidopsis thaliana
agaggctagagaatcgagaatcgatcttcgccgaaccaccttgtcttctcttagctcatcgaatctctccgtcgccgtcgattcttcccgccggtgaatctctgccttattgttttcttcaatttgatcgtcctgaattcatcgtcctatttagggtttcgatcacaatctgaagaggaggtcatggacgtttctgctagaaagtcacaaaaagctgggcgcgaaaagttgaggagggaaaaactgaatgagcattttgttgaactgggaaatgtactcgatccagagagacccaagaatgacaaagccacgattctgactgatactgttcagttgttgaaagagctcacatctgaagtcaacaaactgaaatctgagtacaccgcattgacagatgagtcccgcgagttgacacaagagaaaa

SEQ ID NO: 64 - DNA, 331 bp, Arabidopsis thaliana
cgagaagacgacagaagggaagagttttctcaaacgcttcagggtcatactcagccaacatcagtcttgctgttgaaaactcgtcatggaacgatgagaaacagcttcaggacatgtacttgagccgcaaatcgtttgcgtttgatagtgatgctcctggagcaggaatggctgagaagaagcaggtctttgagatggctcttagcactgcagaagtcaccttccagaacctggattcttcagagatttctttgactgatgtgagccactacttcgattctgaccctacagatctagttcagagtttgatgaaggataataagaaaccaag

SEQ ID NO: 65 - DNA, 436 bp, Arabidopsis thaliana
cgagaagacgacagaagggaagagttttctcaaacgcttcagggtcatactcagccaacatcagtcttgctgttgaaaactcgtcatggaacgatgagaaacagcttcaggacatgtacttgagccgcaaatcgtttgcgtttgatagtgatgctcctggagcaggaatggctgagaagaagcaggtctttgagatggctcttagcactgcagaagtcaccttccagaacctggattcttcagagatttctttgactgatgtgagccactacttcgattctgaccctacaaatctagttcagagtttgaggaaggataagaagaaaccaagctcttacattgctgacactacaactgcaaacgcgcaggtgaggacactatctgagacagtgaggctggacgcaagaacaaagctgctgaatccaaagtggtacga

SEQ ID NO: 66 - DNA, 410 bp, Arabidopsis thaliana
cggacacgtgggctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatccaaaacagctctccttgc

SEQ ID NO: 67 - DNA, 397 bp, Arabidopsis thaliana
atcaatcactctctcttctttagcgtttttattttgtcttcctcgttttcttctacctttttatattttctctcttttcagttttctctagaaaaaaacactagtaatcagtttgcgtttgataaatatttgatgtggcaaaactcttgtggatcttgatgttcaaacattcatgtctccggtgattagtgaaatccttagatctggtttaactatagactcgtctcttagacgcaggacccatcttgttcaatctttctccgtcgtctttctctactggttctatgttttctcataaatcagctctcctttagcgctttattattagatattctataaccataataatatattaaaactatatactataatctttttacataataaactttgggtc

SEQ ID NO: 68 - DNA, 413 bp, Arabidopsis thaliana
  unsure (1)..(413): unsure at all n locations
atctgtttcaatcatggcggagaatggtgaagagaagttacttgctgttgcgcgtcacatagccaaaacacttggccacaatgaatccatggccgatgatatcttacagatcttctccaacttcgacggcagattttctcgcgagaagctcgccgaaggtcaagctggagaagatggatccggagtcgccacactcgagcgagctctaaattcaatagacggtcagatctctcgctttgttgctgcggaccaaccaatttgggctgatcctgcagattcagctgctttcctcgacacaatcgatgagctcgttgcaatcattagagagtggagtcncatggcttcagagaaacctatcggcatctgtctaacacgcgccgacgatatgatgcagcaagctatgttccgcatcg

SEQ ID NO: 69 - DNA, 383 bp, Arabidopsis thaliana
gctatatgacctttttagttagtgactcgagattacataaaatcttctatacactggatccacatctgtttcaatcatggcggagaatggtgaagagaagttacttgctgttgcgcgtcacatatccaatacacttgggcacaatgaatccatggtcgatgatatcttacatatcatctgcaacttcgacggcagattttctcgctagaagctcgccaaaggtcaagctggtgaatatggatccggagtcgccacactcgagcaagctcgaaattcaatatacggtcagatgactcgctttgttgctgcggactaatcaatttgggctgatcctgcagattcagctgctttcctcgatacagtcgatgagctcgttgcaatca

SEQ ID NO: 70 - DNA, 408 bp, Arabidopsis thaliana
catctctctctcgcagctcttctctattttcagcaatcgcctataatattaggtaaagctaaaagggtctgattcgtttgttttttcactgaagaatttggaaggaagtgattccgttgtgaaacataaaagaagtatgggtactcacattgatatcaacaacttaggcggcgatacttctagagggaatgagtcaaagccattggcgaggcagtcttcgttatattccttaacgtttgatgagcttcagagcacattaggtgagccggggaaagattttgggtctatgaatatggatgagttactcaagaacatatggactgctgaggatactcaagcctttatgactactacatcttcggttgcagccccgggacctagtggttttgttccgggaggaaatggttt

SEQ ID NO: 71 - DNA, 398 bp, Arabidopsis thaliana
cccaagcgtccgctctcgcagctcttctctattttcagcaatcgcctataatattaggtaaagctaaaagggtctgattcgtttgttttttcactgaagaatttggaaggaagtgattccgttgtgaaacagaaaagaagtatgggtactcacattgatatcaacaacttaggcggcgatacttctagagggaatgagtcaaagccattggcgaggcagtcttcgttatattccttaacgtttgatgagcttcagagcacattaggtgagccggggaaagattttgggtctatgaatatggatgagttactcaagaacatatggactgctgaggatactcaagcctttatgactactacatcttcggttgcagcccgggacctagtgggtttgttccg

SEQ ID NO: 72 - DNA, 452 bp, Arabidopsis thaliana
caaattacaaaagagaaaagatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaaggggaactttcatcaaacctcaggatacttctggtagatctgacaatggtggagccaatgaatcagaacaagcctctcttgcttcttccaaagctacaccaatgatgagcagtgctataacaagtggatctgagctctctggtgatgaagaagaagctgatggtgaa

SEQ ID NO: 73 - DNA, 429 bp, Arabidopsis thaliana
  unsure (1)..(429): unsure at all n locations
aaaagatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaagggtactcactactctgctcangtttgaatttttttttttttcatagaacaagaaaaacaaaaactttttatctgttagtttgatgagttcacttgaagctaagaaactaatcttgttttgttatgtttgagtgttaagatcntattggaccttttgta

SEQ ID NO: 74 - DNA, 425 bp, Arabidopsis thaliana
  unsure (1)..(425): unsure at all n locations
cttctcttccttatctccttaaaaatcttctgctgttttcttttttatatttagagctcctctgtttcttctccaataaccaaaaaaaaaaaaaaaactcttcctctgtttgttttcaagttctgacatcataaattcagaccgagaaaacataaaaatttgagtcttttgatgatcggaaactgatgactcccgttctctgcgaaatcctgctctctgggctcacggtcaaatctgctctctgccgtagaacccatctcgttcaatctttctccgtcgtcttcctctactggttttacaacgtttcatgaattgctacaaactctaattaattttttcagacagatcatanaaaaaaacaaacataaaacataaaactctgtcctttttttgtcctcttgtaacttttcttgttaaaaatcaat

SEQ ID NO: 75 - DNA, 351 bp, Arabidopsis thaliana
attctcttccttatctccttaaaaatcttctgctgttttcttttttatatttagagctcctctgtttcttctccaataaccaaaaaaaaaaaaaaaaactcttcctctgtttgttttcaagttctgacatcataaattcagaccgagaaaacataaaaatttgagtcttttgatgatcggaaactgatgactcccgttctctgcgaaatcctgctctctgggctcacggtcaaatctgctctctgccgtagaacccatctcgttcaatctttctccgtcgtcttcctctactggttttacaacgtttcatgaattgctacaaactctaattaattttttcagacagatcat

SEQ ID NO: 76 - DNA, 435 bp, Arabidopsis thaliana
  unsure (1)..(435): unsure at all n locations
tacggctgcgagaagacaacagaaggggatgcgtaaacagaaacacgttgatgatctaacggctcagatcaatcagctatcaaacgacaaccgtcagatcttgaacagcctcaccgtaacatctcagctttacatgaagatccaggccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaatanaattaattaaaataattagatgccc

SEQ ID NO: 77 - DNA, 419 bp, Arabidopsis thaliana
tgaaatggacaatggtgatgctacaattcaatctagaagagaagtctttgcattacagggacgaacctttatctcacatcttcgtcatgaacaatgtccattacatagttcagaaggtcaaaagctctccggagctaatggagttgataggagacaagtatttaaggaagcttaccgggatatttagacaagcagctaccaagtatcagagagctacatgggtcagggtgttgaatagcttgagagatgaaggattacatgtgagcggaagcttctcttccggtgtatcgaagagtgctttaagagagaggtttaaagctttcaatacaatgtttgaagaggttcacaggattcaatcgacatggtcggttccggatactcagcttagagaagaactcaggatatctctatcggagcat

SEQ ID NO: 78 - DNA, 393 bp, Arabidopsis thaliana
ctcgagccgctcgagccgctcgagcggctcgagaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagacaaattgcaaggacctctccgacagatcttcgttgagttccttgagcggtcttgtactgctgagttctctggtttccttctctacaatgagcttggtcgaagactcaagattacaaaccctgttgtggctgagatcctctcgcttatgtctagagatgaagcaagacatg

SEQ ID NO: 79 - DNA, 408 bp, Arabidopsis thaliana
  unsure (1)..(408): unsure at all n locations
tcacaatctacagacacctcaaggaaaaccctgagttccaatgttacccaatcttcaagtactttgagaactggtgtcaagacgagaaccgtcatggtgatttcttctctgctttgatgaaagctcagcctcagttcctcaatgactggcaagccaagctctggtctcgcttcttctgcctctcggtttatgtgacaatgtacctcaatgactgccaaagaactaatttctacgagggtatcgggttaaacacaaaggagttcgatatgcatgtcatcatcgagacaaaccgaaccacggcaagaatattccctgcggtgctggatgttgagaaccctgagttcaagaggaaactggatagaatggttgtgagctatgaaaaactgctggctatangagaaacagatg

SEQ ID NO: 80 - DNA, 282 bp, Arabidopsis thaliana
ggatagaatggttgtgagctatgagaagctgctggctataggagaaacagatgatgcttccttcatcaagaccctcaagaggattcctttggttacttctttagcctctgagatcttggctgcttatctcatgcctcctgttgagtctggctctgttgatttcgccgagtttgagcctaatcttgtctattagtagctgcaatgtcaagtcttgagtttacggctggttcttgatttcttgtaattgaatgatcgaaactgagaaacatcgtcttttttttt

SEQ ID NO: 81 - DNA, 410 bp, Arabidopsis thaliana
cccacgcgtccgcggacgcgtgggctctctatctcactctttgcttctgcaactcacagtcaatggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaaaaccgagtacaatcagacaacattcgtgaggaacaaggag

SEQ ID NO: 82 - DNA, 380 bp, Arabidopsis thaliana
gaaactcacagtcaatggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagac

SEQ ID NO: 83 - DNA, 376 bp, Arabidopsis thaliana
atctatctcactctttgcttctgcaactcacagtcaatggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaggaccgattacaaccagacacatttcgtgagga

SEQ ID NO: 84 - DNA, 349 bp, Arabidopsis thaliana
ggatcgccccacgcgtccgctgacggtgctggatgttgagaaccctgagttcaagaggaaactggatagaatggttgtgagctatgagaagctgctggctataggagaaacagatgatgcttccttcatcaagaccctcaagaggattcctttggttacttctttagcctctgagatcttggctgcttatctcatgcctcctgttgagtctggctctgttgatttcgccgagtttgagcctaatcttgtctattagtagctgcaatgtcaagtcttgagtttacggctggttcttgatttcttgtaattgaatgatcgaaactgagaaacatcgtctttttttttttgc

SEQ ID NO: 85 - DNA, 218 bp, Arabidopsis thaliana
aatttgcttctgcaactcacagtcaatggcggctgaaatggcgttagtgaaacccatctccaagttctcttccccaaagctctcaaacccgagcaaattcctctccggccgacgtttctccaccgtgattagaatgtcagcctcgtcctcatcgcctcctccaaacaccggcaactcgaagtccaaaaagggaacgaagaaagagattcaagagtcgc

SEQ ID NO: 86 - DNA, 444 bp, Arabidopsis thaliana
cgctacttctgcctctcggtttatgtgacaatgtacctcaatgactgccaaagaactaatttctacgagggtatcgggttaaacacaaaggagttcgatatgcatgtcatcatcgagacaaaccgaaccacggcaagaatattccctgcggtgctggatgttgagaaccctgagttcaagaggaaactggatagaatggttgtgagctatgagaagctgctggctataggagaaacagatgatgcttccttcatcaagaccctcaagaggattcctttggttacttctttagcctctgagatcttggctgcttatctcatgcctcctgttgagtctggctctgttgatttcgccgagtttgagcctaatcttgtctattagtagctgcaatgtcaagtcttgagtttacggctggttcttgatttcttgtaattgaatgatcga

SEQ ID NO: 87 - DNA, 408 bp, Arabidopsis thaliana
cactctaactcactctttgcttctgcaactcacagtcaatggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagacaaat

SEQ ID NO: 88 - DNA, 421 bp, Arabidopsis thaliana
ctcactctttgcttctgcaactcacagtcaatggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagacaaattgcaaggacctctccgacaga

SEQ ID NO: 89 - DNA, 403 bp, Arabidopsis thaliana
actctatctcactctttgcttctgcaactcacagtcaatggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagac

SEQ ID NO: 90 - DNA, 439 bp, Arabidopsis thaliana
cccacgcgtccgcccacgcgtccgtacggctgcgagaagacgacagaagggtacggctgcgagaagacgacagaaggggactagagataaccctagaaagatctctctcgatctctggttcgaagaaaatccaccatttccgattgttctttctctttgacaaaacccagatagataaaaattcgttccaattccagtgagctccggaaatggcgtccttcaagttgatgccttcttccaattccgacttgtctcgccgtaattcttcttctgcttcattttccccttctataagatcatcgcaccatctccgaccaaatcctcacgccgatcactccagaatcagtttcgcttacggcggaggagtcaacgattatactttcgcgtctgattcaaagcccttcgagatggcgattgatgttgatcggagtatcggaga

SEQ ID NO: 91 - DNA, 416 bp, Arabidopsis thaliana
tacggctgcgagaagacgacagaagggggatctctggttcgaagaaaatccaccatttccgattgttctttctctttgacaaaacccagatagataaaaattcgttccaattccagtgagctccggaaatggcgtccttcaagttgatgtcttcttccaattccgacttgtctcgccgtaattcttcttctgcttcatcttccccttctataagatcatcgcaccatctccgaccaaatcctcacgccgatcactccagaatcagtttcgcttatggcggaggagtcaacgattacactttcgcgtctgattcaaagcccttcgagatggcgattgatgttgatcggagtatcggagatcggaacagcgttaacaacggaaagagtgttgacgatgtttggaaagagattgtatct

SEQ ID NO: 92 - DNA, 444 bp, Arabidopsis thaliana
acattctgtttttaattcccctaaaaacccattttaaaatattttatctctcttctcttaaaaaaaactcttccctgtttttgtttgtgtgttactaaatggaatcgtcgtcgtcgggaacaacttcgtcgacgattcaaacgtcgtcaggatcggaggagagtctcatggagcagaggaaacgtaaacggatgctctcaaaccgtgaatctgcaaggagatcaagaatgaagaaacaaaagctcctagacgatctaacggctcaggttaatcatctgaaaaaagagaacacggagatcgtgacaagtgtcagcatcacaacgcaacactacctaaccgttgaagcagagaactctgttctcagagctcagcttgatgaacttaaccacaggctccaatctctcaacgacatcatcgagttcctcgacagtaacaacaacaaca

SEQ ID NO: 93 - DNA, 408 bp, Arabidopsis thaliana
attaaaatggctgctcgtgtcgaggcggcagcaacacacttgtcgtctctccctgtagcttctctggagttttcgcagtcacgaatcttgttttgaagaaattaatttgaacaagggttttagggcttggatgctttgttttcattgaagaagaagtagaaggagtgtatacaaggattatgggaactcacatcaatttcaacaacttaggaggtggtggtcatcctggaggggaagggagtagtaaccagatgaagccaacgggtagtgtcatgcccttggctaggcagtcctcggtctactcccttacctttgatgagttacagaacacactaggtggaccgggaaaagattttgggtccatgaacatggatgaactcctgaagagcaatatgactgctgaagaaa

SEQ ID NO: 94 - DNA, 327 bp, Arabidopsis thaliana
tacggctgcggacgacagaaggggacagagacggagatggtctcatatctcaacttgagttgggagaaggaatgaaggacatggggatgaagataacagcagaagaagcggagcatatggtccgagaagccgaccttgatggcgatggttttctttctttccacgaattctctaaaatgatgattgctgcctcttgttagcattttgtgaaatgccatgatttaagagtttgtttttgcacaattacaactatatttcaatatgttactatattttcccaacatataattaaagtgtgtgttactgtaaaaaaaacataacacagtc

SEQ ID NO: 95 - DNA, 214 bp, Arabidopsis thaliana
cggacgcgtgggcggacgcgtgggcggacgcgtgggttcaggtttcttttctaacaagcaaaaactccaacctttactttatttttgttttgttttgtaaccctctcagatcttaattctcaaagaagtatgaagagagaaagatctgatttcgaagaatccctcaagaatattgacattgctaaatgtctgatgatactagcacaaacctcca

SEQ ID NO: 96 - DNA, 399 bp, Arabidopsis thaliana
aggttttttttttgttcctttcttaaatttcgaaagaaagacatttattaaaccaaaataactctttagatcattgcaaggaaaaatgttgaaaagtgcaagtccaatggcattctacgatatcggagagcagcaatactctactttcgggtacattttaagcaaacctgggaacgcaggagcttacgagattgacccttcgatcccaaacatcgacgatgcgatctacggctcagatgagttccgtatgtacgcttacaaaatcaaacggtgtcctcgtactcgtagccacgactggacggagtgtccctacgctcaccgtggcgagaaagccacacgccgtgatcctcgccgttacacttactgtgcagtcgcatgcccggctttccgaaatggcgc

SEQ ID NO: 97 - DNA, 308 bp, Arabidopsis thaliana
taaatttcgaaagaaagacatttattaaaccaaaataacgctttatataattgcaaggaaaaatgttgaagaatggaattcgaagggcattctacgatatcggaaagcagcaatactctactttcgggtacaatttaagcaaacctgggaatgcaggagcttacgacattgacccttcgatctgaaacatcgacgatgcgatatacggctcatatgacttccgtatgtacgcttacaaaatcaaacggtgtcctcgtactcgtacttacgactggacgagatgtcactaccatcatcgtgacgagaaa

SEQ ID NO: 98 - DNA, 411 bp, Arabidopsis thaliana
acacacttctaaactttagcctcacaatattcttctctctgtctctctctaagtcatctctttgaacatcagggattaattactgtaattgaagctcacatcatggaccatcatcagtatcatcatcatgatcaataccaacatcagatgatgactagtactaacaataattcctataacaccatcgtcacaacacaaccaccatcaacaacaacaacaatggattcaacaacagcaataactatgataatggatgacgataagaagttgatgacgacaatgagcactaggccgcatgaaccaagagactgtccaagatgcaactcaagcaacaccaagttttgttattacaagaactacagcttagcacagcctatgtacatgtgtaagtcctgtcggagatattggact

SEQ ID NO: 99 - DNA, 412 bp, Arabidopsis thaliana
agatgatgaagcttgtgaggttgatgaggagtcttcaagtaatcatacttgtcaagaatgtggtgctgagtttaagaaacctgctcacttgaagcagcatatgcagagtcattcgctcgagagatcttttacttgctatgtggatgattgtgctgctagctataggaggaaggatcatctcaataggcatcttcttacacataaagggaagctctttaagtgtccgaaggagaactgcaagagtgaattctcagtacagggaaatgttggtaggcatgttaagaaatatcatagtaatgacaaccgtgataaggacaatactggtttgggcgatggtgataaggacaatacttgtaagggggatgatgataaggaaaaatctggtagtgggcggttgtgagaagggaaaatg

SEQ ID NO: 100 - DNA, 439 bp, Arabidopsis thaliana
agcagatcccctccttatcgtggttcacgccgtgattctcctcgccgcagagactcgccctatggtcgacgttcgccatatgccaatggggtgtgaaactggaccctgaagagaaagaagctattactaagctatgatgctatatctactctgtggcgccttttaggatagatctttatatctgctattatggtattagctcttctaggtttggttgttgagcatggacatgtcatggtatgttcgagttttattagacaattggatttggtgagttctccttcatgctgttttccaacagccgtcttgacttattctctataacacgcactggcctgctgtcttcacacagcgtccttgaacccctacacttgaggtcgttctttcgtatccataaatgttttgtctaaaaaacattgttaaaaggaaagtaagatga

SEQ ID NO: 101 - DNA, 416 bp, Arabidopsis thaliana
acggacgactcaaccgagtgagttctctctactgagtcttgcatacatctccgctctcagctctttcccagattccacaaattccatcgccggagcttcttcgatctcaaaggctcgtatcctcggccacgttgccgcctgaatcggacgcagagacgacgaaaaaggtaacctaactgcagatctcatcggagaactccacgaacaaccacctccgttcaattgcattttcctcatcgacgcaataagttcaccggtactcggagaaagcggcggagattccgacggtggtgaaaacgaaggagaaacaagaatcgaagtcggagaagtagctaatcctgagaagaatccaagatctggatctaacgaacaaggtaatacacgtaactgctccgtcgtatgagcgaagagacaga

SEQ ID NO: 102 - DNA, 360 bp, Arabidopsis thaliana
acggacgcgtggggttctccgatgagatctgcagttaggttacctttttcgtcgtctctgcgtcggattcacgcggcaacgtggccgaggataagagagtttgagatcgaagaagctccggtgatggaatttgtggaatctgggaaagagctgagagcggagatgtatgcaagactcagtagagagaactcagtcggttgagtcgacttggatcgagtctgtgatgacgtggcgactcgatctgattttgtggatattctagagatgtttaaggtgttgtggagaaatgacctggcgggtcgatcttagtgacggtacaatcggacgatgaagacatcagcgttaagagtatcatactca

SEQ ID NO: 103 - DNA, 120 bp, Arabidopsis thaliana
gaattggcttcaccactctcaaaagaaaacgagaaccggtttggtgtgtagatcatcttgaacctttttgaggttttcacattctgagtttatattaagagagggaataatattttggtt

SEQ ID NO: 104 - DNA, 381 bp, Arabidopsis thaliana
caatgacacaaatgatcaaggaggagactttgaatgtaacatttgtttcgaactagctcaagatccgattgtcactctctgtggccatctcttttgctggccttgcttataccgttggcttcaccaccattcacattctcaagaatgtccggtttgtaaagccgtggttcaagacgataagcttgttcctctttacggtagaggcaagaaccagactgacccgagatcaaaacgttatccgggtttacggattcctaaccgaccaacaggtcaaagacctgatactgctgctcctcctcctcagcctgaagctgcgagtaattttttcaactaccgtattggcttgatgggtggaattactccgaatgatggcgaactacc

SEQ ID NO: 105 - DNA, 281 bp, Arabidopsis thaliana
gtctggtttcctcttttgtttcgtccaaatctctactttttagggatcttgtccttctcttttctgctgattaaaaccctcgaatttgctccaattcgacgcgaaaaagggcattgagatggtgaatggagaatcatcaactagtacgtcttactctgatagtaacaatgacacaaatgatcaaggaggagactttgaatgtaacatttgtttcgaactagctcaagatccgattgtcactctctgtggccatctcttttgctggccttgcttataccgtc

SEQ ID NO: 106 - DNA, 374 bp, Arabidopsis thaliana
caagatgtctggtttcctcttttgtttcgtccaaatctctactttttagggatcttgtccttctcttttctgctgattaaaaccctcgaatttgctccaattcgacgcgaaaaagggcattgagatggtgaatggagaatcatcaactagtacgtcttactctgatagtaacaatgacacaaatgatcaaggaggagactttgaatgtaacatttgtttcgaactagctcaagatccgattgtcactctctgtggccatctcctttgctggccttgcttataccgttggcttcaccaccattcacattctcaagaatgtccggtttgtaaagccgtggttcaagaacgataagcttgttcctctttacggtaga

SEQ ID NO: 107 - DNA, 380 bp, Arabidopsis thaliana
ccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccctcccaacaaggctttaagcggtcacaaagcaagtcaccgaatcaaaccaccaaccg

SEQ ID NO: 108 - DNA, 441 bp, Arabidopsis thaliana
  unsure (1)..(441): unsure at all n locations
atcattctctctgatctcaagaaataatctcaaatctcttacactcatagtcttcaagcaacttctcagattcagctcttatggatcatttgttacaacaccaggatgtttttgggaattataacaaagcaagagaagcaatgggactatcatattcatcaaacccaacaccgttagataacgaccagaagaaaccttctcctgcaacggctgtgacaaggccacagcctccggagctagctctcaggtgtccacgttgcgactcaacanacacaaagttttgttactacaacaactacagtctcactcagcctcgctacttctgcaaatcatgccggagatattggactaaaggtggaactctaaggaacatccccgtgggtggaggctgccggaaaaacaaacgatccacatcttcggctgcaagaagcctcagaacca

SEQ ID NO: 109 - DNA, 351 bp, Arabidopsis thaliana
ctcaaatccatcattctctctgatctcaagaaataatctcaaatctcttacactcatagtcttcaagcaacttctcagattcagctcttatggatcatttgttacaacaccacgatgtttttgggaattataacacagcaagagaagcaatgggactatcatattcatcaaacccaacaccgttagataacgaccagaacaaaccttctcctgcaacggctgtgacaatgccacaggctccggagctagctctcaggtgtccacgttgcgactcaacaaagacaaagttttgttactacaacaactacagtctcactcaacctcgctacttccgcaaatcatgcggagata

SEQ ID NO: 110 - DNA, 430 bp, Arabidopsis thaliana
cctcaaactctctctttctctctctctctctggttccctagaatttgagcaaaatttctaccataattgctaattattaaaaggaaacataagtaatcgttgcttcgatcctttgttacatggatggatcctgaacaggaaatctcaaacgagactttggaaactatattggtaagttcaacagaaggaagcaataataacaataagaaaatggaagaagaaatgaagaagaaagtatcaagaggagaattaggaggtgaagctcaaaattgtccaagatgtgaatctccaaacacaaagttttgttactacaacaactatagtctctcacaacctcgttacttctgcaaatcttgtcggagatattggactaaaggcggtactcttcgtaacgttcccgtcggtggtggttgccgtcgaaacaaacgat

SEQ ID NO: 111 - DNA, 478 bp, Arabidopsis thaliana
ccaaagacctccaaagtgtcaatctttacttctctctttttctccaagttatcttcttttcgaggaagagatatgtgcggtgcaaagagcaacctttgctcatctaaaaccctatcagaagtcgaattcatgaggcagaaatcagaagacggagcttccgccacgtgtctcctcgaattcgccgtctgtgatgatctttcatcgtttaagagagagatcgaagagaatccatcggcggagattgatgagtcagggttttggtattgcagacgggtcgggtctaagaagatgggttttgaagaaagaacaccacttatggatgctgctatgtatggaagcatggaagtgttgaattacataattgccacaggaagatccgatgtgaacagagtttgcagtgacgagaaagtcactgctcttcactgtgcagtttctggctggactgtttctatcgatgagatcatcaagatcttgcttg

SEQ ID NO: 112 - DNA, 371 bp, Arabidopsis thaliana
atcttcaccccaaaaacctccaaagtttcaatctttacttctctctttttctccaagttatcttcttttctaggaagagatatgtgcggtgcaaagagcaacctttgctcatctaaaaccctaacagaagtcgaattcatgaggcagaaatcagaagacggagcttccgccacgtgtctcctcgaattcgccgcctgtgatgatctttcatcgtttaagagagagatcgaagagaatccatcggtggagattgatgagtcagggttttggtattgcagacgggtcgggtctaagaagatgggttttgaagaaagaacaccacttatggttgctgctatgtatggaagcatggaagtgttgaattacataaa

SEQ ID NO: 113 - DNA, 409 bp, Arabidopsis thaliana
cccacgcgtccgcttcttctccccaaaaacctccaaagtttcaatctttacttctctctttttctccaagttatcttcttttctaggaagagatatgtgcggtgcaaagagcaacctttgctcatctaaaaccctaacagaagtcgaattcatgaggcagaaatcagaagacggagcttccgccacgtgtctcctcgaattcgccgcctgtgatgatctttcatcgtttaagagagagatcgaagagaatccatcggtggagattgatgagtcagggttttggtattgcagacgggtcgggtctaagaagatgggttttgaagaaagaacaccacttatggttgctgctatgtatggaagcatggaagtgttgaattacataattgccacaggaagattcgatgtgaac

SEQ ID NO: 114 - DNA, 400 bp, Arabidopsis thaliana
acttcttctccccaaaaacctccaaagtttcaatctttacttctctctttttctccaagttatcttcttttctaggaagagatatgtgcggtgcaaagagcaacctttgctcatctaaaaccctaacagaagtcgaattcatgaggcagaaatcagaagacggagcttccgccacgtgtctcctcgaattcgccgcctgtgatgatctttcatcgtttaagagagagatcgaagagaatccatcggtggagattgatgagtcagggttttggtattgcagacgggtcgggtctaagaagatgggttttgaagaaagaacaccacttatggttgctgctatgtatggaagcatggaagtgttgaattacataattgccacaggaagatccgatgtgaacag

SEQ ID NO: 115 - DNA, 412 bp, Arabidopsis thaliana
cggacgcgtgggcggacgcgtgggcggacgcgtgggcggacgcgtgggcggacgcgtgggctcaatttggattggattttctgcatatcatcgctctagctttcgcgggttttggattcgattccttacccttctccaatcgaagtttttggctttgaattggatttgggtttcgttccaaaatcagctctttttgttaatcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctg

SEQ ID NO: 116 - DNA, 343 bp, Arabidopsis thaliana
cggacgcgtgggcggacgcgtgggcttaaaaaccaaatctttcatcatcttccttcaccagttgactctctttcaatctagctctgaatctctcactctcctacccgagaaccatgaactccaacgaccaggatccgattccgttcagacccgaagacaacaacttctccggttccaaaacctacgccatgagcggcagaatcatgctaagtgcaatagtaatcctcttcttcgtcgtcattttaatggtcttcctccatctttacgctcgttggtatctcctccgtgctcgtagacgtcatcgccgtcgtcgtagccgtaaccgtcgcgctacgatggtttt

SEQ ID NO: 117 - DNA, 417 bp, Arabidopsis thaliana
ttcacctctctctctctttcttctccactgtaacctcccaattcaaaaacaattataaaccaaacttgattaatatatatttctttatcatcatctcttcgaaatgcaagatattcatgatttctccatgaacggagttggtggtgggggaggaggaggagggaggtttttcggtggaggaattggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaacgtggtgttctccgtaacgtttccgtccgaagtggttgccggaaagctaaacg

SEQ ID NO: 118 - DNA, 391 bp, Arabidopsis thaliana
cccacgcgtccgcccacgcgtccgaaatctagaaagagaaaaagtcttaaatttgtctcatttatgcgataagaaccacaattcctctatcaaaatctctctctctgacatacccagttggaaaaattcaatcttttatccctaagattcgatctttcttcttgggaagttgataaatgttcaaggaaacataaaaaagagaagatttttgaataaaggttgaagaaaaatgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcac

SEQ ID NO: 119 - DNA, 421 bp, Arabidopsis thaliana
  unsure (1)..(421): unsure at all n locations
actctttcgtcgactaatgtgatttattgttcaccggagtattaaagaagatgatgatcggagaaactcgcaggacttatcccactgttgaaatacctccatggccggtacttgaagagcttacaacgtcggagttttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccganggaagtacattactctggtacgg

SEQ ID NO: 120 - DNA, 411 bp, Arabidopsis thaliana
aactctttcgtcgactaatgtgatttattgttcaccggagtattaaagaagatgatgatcggagaaactcgcaggacttatcccactgttgagatacctcgatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattac

SEQ ID NO: 121 - DNA, 395 bp, Arabidopsis thaliana
  unsure (1)..(395): unsure at all n locations
aaagaactctttcgacgactaatgtgatttattgttcaccggagtattaaagaagatgatgatcggagaaactcgcaggacttatcccactgttgaaatacctccatggccggtacttgaagagcttacaacgtcggagtttttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcncggagaaaaagctcgccggag

SEQ ID NO: 122 - DNA, 427 bp, Arabidopsis thaliana
  unsure (1)..(427): unsure at all n locations
aaaaaaaaagaactctttcgtcgactaatgtgatttattgttcaccggagtattaaagaagatgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcncggagaaaaagctcgccggagagattcgaggaagttacattactctggg

SEQ ID NO: 123 - DNA, 431 bp, Arabidopsis thaliana
cccacgcgtccgtacggctgcgagaagacagaagggggccggagtcatgattggacggagtgtccatacgctcatcccggagaaaaagctcgccggagagatccgaggaagtaccattactctggtacggcttgttctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgtttctttgcccattcaccggatcagcttaggtttttacatactcggagccctgacagagttgattcttttgacgtttcgtctccgattcgtgctagagcatttcagctgtcgatttctccggtttctggttcgccaccgatgagtccaagagctgactc

SEQ ID NO: 124 - DNA, 306 bp, Arabidopsis thaliana
gcctattgttgccgttgcttgctatctttcgccgtcgtctctttagcttcttgcgaagatggttcttcaaaacgatatcgatctgcttaacccacctgctgagcttgagaagaggaagcacatgctcaagcgtcttgtccagtctcccaattccttcttcatggatgtgaagtgccaaggctgtttcaacatcactactgttttcagtcactcgcagactgttgtggtgtgcggaaactgccaaacaactctgtgccagcctacaggaagtaaggcaaagctcaccgaaagatgctcattcatgat

SEQ ID NO: 125 - DNA, 420 bp, Arabidopsis thaliana
aatttcttcacaaagcaaaacacagaaaaagccattctttttgccccttgagtgctttcagctcttcccacaaggttacagaagtaatgtcacgtgtgtacgtcggaaatttggacccgcgagttactgagcgtgaacttgaggatgagttccgtgcctttggagttgtcaggagtgtttgggttgcccgtagaccacctggttacgcttttctagatttcgaagatcctagggatgcccgtgatgctatccgtgctttagatggcaagaatggctggagggttgaacagtctcacaatcgaggtgagcgtggtggcggcggtcgtggtggtgaccgtggaggtggtggcggcggccgtggtggtcgtggtggctctgatttgaaatgctatgaatgcggtgagactggtcatttcgcac

SEQ ID NO: 126 - DNA, 407 bp, Arabidopsis thaliana
accacgcgtccggaaaaagccattctttttgccccttgagtgctttcagctcttcccacaaggttacagaagtaatgtcacgtgtgtacgtcggaaatttggacccgcgagttactgagcgtgaacttgaggatgagttccgtgcctttggagttgtcaggagtgtttgggttgcccgtagaccacctggttacgcttttctagatttcgaagatcctagggatgcccgtgatgctatccgtgctttagatggcaagaatggctggagggttgaacagtctcacaatcgaggtgagcgtggtggcggcggtcgtggtggtgaccgtggaggtggtggcggcggccgtggtggtcgtggtggctctgatttgaaatgctatgaatgcggtgagactggtcatttcgca

SEQ ID NO: 127 - DNA, 425 bp, Arabidopsis thaliana
accacgcgtccgtacgcagaagacgacagaaggggaaagcaaaacacagaaaaagccattctttttgccccttgagtgctttcagctcttcccacaaggttacagaagtaatgtcacgtgtgtacgtcggaaatttggacccgcgagttactgagcgtgaacttgaggatgagttccgtgcctttggagttgtcaggagtgtttgggttgcccgtagaccacctggttacgcttttctagatttcgaagatcctagggatgcccgtgatgctatccgtgctttagatggcaagaatggctggagggttgaacagtctcacaatcgaggtgagcgtggtggcggcggtcgtggtggtgaccgtggaggtggtggcggcggccgtagtcgcactcctccaagatacagaaggagcctaagctatgga

SEQ ID NO: 128 - DNA, 411 bp, Arabidopsis thaliana
tacggctgcgagaaaacgacagaagggggcggtagagagaaagagaggaaagcttaagccgacgacgacgacgaagatgagagagacggtgaagttgataagcatggaaggtttcgagttcgtcatcgacagagaagccgctatggtttctcagactatccgaagcatgctcacttctccaggtggtttctcggaatcgaaagatggcgtagtgactttccctgatataagcaccacaatactagagaagatttgccagtacttctactggtctcttcaatactccagaggcaaagagacagagtttcatattgagcctgaactgactctagagctgatgatggctgctaactatcttcacacttgaagaatgaaaaggataacgctgttgaatcttattcgacttgtgtg

SEQ ID NO: 129 - DNA, 453 bp, Arabidopsis thaliana
  unsure (1)..(453): unsure at all n locations
cccacgcgtccgtacgctgcgagaagacgacagaaggggacgtcgcggtagagagaaagagaggaaagcttaagccgacgacgacgacgaagatgagagagacggtgaagttgataagcatggaaggtttcgagttcgtcatcgacagagaagccgctatggtttctcagactatccgaagcatgctcacttctccaggtggtttctcggaatcgaaagatggcgtagtgactttccctgatataagcaccacaatactagagaagatttgccagtacttctattggtctcttcaatactctagaggcanagagacagagtttcatattgagcctgaactgactctagagctgatgatggctgctaactatcttcacacttgaagaatgaaaaggataacgctgttgaatcctagtcgacttgtgtgaaatcaaaaggtaaatccgcattggg

SEQ ID NO: 130 - DNA, 387 bp, Arabidopsis thaliana
gattaagccatgttctacggcttattctcatgattggaccgagtgtgcttttgttcatccgggagaaaatgcgaggaggagagatccgaggaagtatccttacacttgtgtcccctgtcgcgagttccgtaaaggatcatgcccgaaaggagattcttgcgagtatgctcacggggttttcgagtcgtggcttcaccccgcgcagtataaaacccggctttgtaaagatgaaacgggttgtgcaaggaaagtttgtttctttgctcataaacgcgaagagatgagacctgttaatgcttcaactggctctgccgtggctcaatctccgtttatcagcttggagatgatgccaaggttgtctcctcttgcttagtcttcaggagtttc

SEQ ID NO: 131 - DNA, 437 bp, Arabidopsis thaliana
gcggttgaggttttactgaccgggattcatggttcggttatggaagaagaggaggaggaactgaagagtgttgtgactaagtatccagctgatgcatcacttcctgatattaacgaaggtgtttatggaactgatgattttaggatgtttagctttaaggttaagccatgttctagggcttattcacatgattggactgaatgtccttttgttcatcctggtgagaatgcaaggaggagagatcctaggaagtatccttacacttgtgtgccttgtcccgagtttcgtaaagggtcttgtcctaaaggagattcgtgtgagtacgcgcacggtgttttcgagtcttggcttcacccggcgcagtataggacacggctttgcaaagatgagactggttgtgctaggagagtttgtttctttgctcatagacgggatga

SEQ ID NO: 132 - DNA, 422 bp, Arabidopsis thaliana
cttgtttcttcatcatcacctacttcaatcaaaaaacattccaactttcttctcaatttcattccaggatagtattatgtgcagtggaccaaagagcaatctctgctcttcaagaaccttaacagaaatcgaatcaaggcaaaaggaagaagaaacaatgcttctcctcgaattcgctgcttgtgatgatcttgactcgttcaagagagaggttgaagagaaagggcttgatttggatgagtcagggttatggtattgcagacgtgtcggttctaagaagatgggtcttgaagaaagaacacctttaatgggtgcagctatgtatggaagcataaaggttttgactttcatcgtttccactggaaaatctgatgtgaacagagcttgtggtgaagagagagttactccgcttcactgtgctg

SEQ ID NO: 133 - DNA, 339 bp, Arabidopsis thaliana
cagacgcgtccgcccacgcgtccggttgaagagaaagggcttgatttggatgagtcagggttatggtattgcagacgtgtcggttctaagaagatgggtcttgaagaaagaacacctttaatggttgcagctatgtatggaagcataaaggttttgactttcatcgtttccactggaaaatctgatgtgaacagagcttgtggtgaagagagagttactccgcttcactgtgctgttgctggctgttctgtgaatatgattgaagtcatcaatgtcttgcttgatgcttctgctttggttaactctgttgatgctaatgggaatcaacctttggatgtg

SEQ ID NO: 134 - DNA, 389 bp, Arabidopsis thaliana
tacccacgcgttctgcggaaccgtggggttttgactttcatcgtttccactggaaaatctgatgtgaacagaccttgtggtgaagagagagttactccgcttcactgtgctgttgctggctgttctgtgaatatgattgaagtcatcaatgtcttgcttgatgcttctgctttggttaactctgttgatgctaatgggaatcaacctttggatgtgtttgttcgagtttcgaggtttgtggctagtccgaggaggaaagcggttgagttgttgctgagaggaggaggtgttggaggattgatcgatgaggcggttgaagaagagatcaagattgtctctaagtatccagctgatgcttctttaccggatataaacgaaggggtttatgg

SEQ ID NO: 135 - DNA, 138 bp, Arabidopsis thaliana
gtcgagcactggacaaagggtaagcgatctaagagatctagatccgatttccaccatcaaaacctcactgaggaagagtatcgaactttttgcctcatgcttcccgctcgcgacaaccgtcagcctcctcctcctccg

SEQ ID NO: 136 - DNA, 424 bp, Arabidopsis thaliana
aatttcttcactgcaattcacaagcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaagagatga

SEQ ID NO: 137 - DNA, 409 bp, Arabidopsis thaliana
cttcactgcaattcacaagcaaccttcaaactaaaactcgagagacaagaaatcctcagaatctttaacttaatggcgctcgacgctcttacatcaccaagattagcttctccgattcctcctttgttcgaagattcttcagtcttccatggagtcgagcactggacaaagggtaagcgatctaagagatcaagatccgatttccaccaccaaaacctcactgatgaagagtatctagctttttgcctcatgcttctcgctcgcgataaccgtcagcctcctcctcctccggcggtggagaagttgagctacaagtgtagcgtctgcgacaagacgttctcttcttaccaagctctcggtggtcacaaggcaagccaccgtaagaacttatcacagactctctccgggg

SEQ ID NO: 138 - DNA, 369 bp, Arabidopsis thaliana
catcaaactaaaactcgagagacaagaaatcctcagaatctttaacttaatggcgctcgaggctcttacatcaccaagattagcttctccgattcctcctttgttcgaagattcttcagtcttccatggagtccagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttagcaagctctcggtggtcacaaggcaagccaccgtaagaacttatc

SEQ ID NO: 139 - DNA, 343 bp, Arabidopsis thaliana
acttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtca

SEQ ID NO: 140 - DNA, 219 bp, Arabidopsis thaliana
  unsure (1)..(219): unsure at all n locations
tacagctgcgagaagacgacagaaggggcagcaattaaacaatttcttcactgcaattcacacgcaaccttcaaactaaaactcgagagacaagaaatcctcagaatctttaacttaatggcgctcgaagctcttacatcaccaagattagcttctccgaatcctcctttgttcgaagattccntcagtcttccatggaagtccaacgccgggcaaagg

SEQ ID NO: 141 - DNA, 395 bp, Arabidopsis thaliana
cttgagaatcctctcttcaaagccatggcgttagaactatggcaaactctcaaagaagcaatccatgcttacacaggtctttctcctgttgtcttcttcactgctctagctctcgccttcgccatttaccaagtcatctcaggctggtttgcctcgccgttcgatgatgttaaccgacatcagagagctagatccttggctcaagaggaggagccaccgattcctcagcctgttcaagtcggtgagatcacggaggaggagcttaaacagtacgatggctctgatcctcaaaagccccttcttatggctatcaaacatcagatctatgatgttacacagagcaggatgttctacggaccaggaggaccatatgctttgtttgcagggaaagacgc

SEQ ID NO: 142 - DNA, 427 bp, Arabidopsis thaliana
caaaaatgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccggcaccgcttgtcctgagtttcgtaa

SEQ ID NO: 143 - DNA, 419 bp, Arabidopsis thaliana
tgaagatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccggcaccgcttgtcctgagtttcgt

SEQ ID NO: 144 - DNA, 389 bp, Arabidopsis thaliana
atcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactc

SEQ ID NO: 145 - DNA, 390 bp, Arabidopsis thaliana
cggacgcgtgggtgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgtgacctcccgtcaaacgagttaacaaacgattcagactcatcaagtggcgacgagtcatcaccactcaccgactcattctcctccgacgagtttcgcatctacgagttcagaatcgggcgattcgctcgaggtcaatctcaggattggacggagtgtccgttcgcagatcccggagaagaagccgacgacgtgatccgag

SEQ ID NO: 146 - DNA, 409 bp, Arabidopsis thaliana
gagaaaatacgaaccggccacatccaaggatccatatccctcaatgggatcaaatcaacgatccaacggccacaatctcttcaccattctcttccgtcaaccttaacagcgttaacgactacccacactctccgtcatcgtatctcgactccttcgcttctctcttccgttacctcccgtcaaacgagttaacaaacgattcagactcatcaagtggcgacgagtcatcagcactcagcgactcagtctcctccgacgagtttcgcatctacgagttcaaaatccggcgatgcgctcgacgtcgatctcatgattggacggagtgtccgttcgcacatcccggagaaaaagctcgacgacgtgatccgagaaagtttcattaatccggcaccgcatgtcctgagtttcg

SEQ ID NO: 147 - DNA, 408 bp, Arabidopsis thaliana
caaaaatgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctcgcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccgggaacg

SEQ ID NO: 148 - DNA, 359 bp, Arabidopsis thaliana
gcgaaaataaaaaccggccacatccaacgatccatatccctcaatgggatcaaatcaacgatccagcggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaacgactcattctcctccgacgagtttcgcatctacgagttcaagatccggggatgcgctcgatgtcgatctcatgagtggacggagtgtccgttcgcacatcccggagaaaaagctcgacga

SEQ ID NO: 149 - DNA, 418 bp, Arabidopsis thaliana
cacacacgtccgtagagaagcagatccaagagcttgtagaggcaattgtgcttcccatgacgcacaaggaacgttttgagaagctgggtgttcgtccaccaaagggagtgctcttgtatggtcccccagggactggtaaaactttaatggctcgtgcctgcgcagcacagaccaatgccaccttccttaaattggcaggccctcaattggtccagatgttcattggagacggagcaaagcttgtccgtgatgcctttcaacttgccaaagagaaagctccgtgcattatcttcatagatgaaatcgatgccattggtacaaagcgtttcgacagtgaagtcagcggagacagggaagtgcagaggactatgttggagttgctcaatcaacttgacggattcagtagcgatgaacgtat

SEQ ID NO: 150 - DNA, 434 bp, Arabidopsis thaliana
ctgacatcacaagtctcttccttccagtctcttgccggatcatacaagcaaccattcattctatcctcccaggattcttcagctgttgtgttaccggattccacaaactcaccgctgtttcatgatgtgtgggacactcagttgaacggtctcaagtttgaccagttcagtcccttgatgcagcaggacctttatgctagtcagaatatctgtatgagtaatagcacaaccagtaacattctagatcctccactctcaaacacagtccttgatgacttctgtgccatcaaagacactgatttccagaaccacccttctggttgtttggttggaaacaacaacactagctttgctcaagatgtccagtcgcagatcacatcagctagctttgcagactcacaggccttctctcgccaagattttccagataattc

SEQ ID NO: 151 - DNA, 280 bp, Arabidopsis thaliana
ctttgacacatttctggtgggtggggatactgctgaggttaacgatataaaattcagcaacgatgggaaatccatgctcctaacgactacaaataacaatatctacgttcttgatgcatatcgtggagagaagaaatgtggttttagtttggagccttcacagggtacacccatagaggccaccttcacaccagatggcaagtatgttctgtcaggttcaggtgatggaaccttacatgcgtggaacatcgagaacccatctgaggtggcgaggtgggag

SEQ ID NO: 152 - DNA, 442 bp, Arabidopsis thaliana
  unsure (1)..(442): unsure at all n locations
ggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggangaggaggcaacctctgatgagaacacttcagaagcaagttccagcctc

SEQ ID NO: 153 - DNA, 419 bp, Arabidopsis thaliana
aatatatctcgtgaatgttctctgagaattctctagatcttcaatcaaaagttatctctctctctcacctattgtaaaaatcaccagtttcgtatataaaaccctaattttctcaaaattcccaaatattgacttggaatcaaaaatccgaatggatgtgagcaaagtaaccacaagcgacggcggaggagattcaatggagactaagccatctcctcaacctcagcctgcggcgattctaagttcaaacgcgcctcctccgtttctgagcaagacctatgatatggttgatgatcacaatacagattcgattgtctcttggagtgctaataacaacagttttatcgtttggaaaccaccggagttcgctcgcgatcttcttcctaagaactttaagcataataatttctccagcttcg

SEQ ID NO: 154 - DNA, 358 bp, Arabidopsis thaliana
agctctctttcccagcatcaccatctcttgtaccagtttctgattagattcaacaatgaacggcgcattaggtaactcctccgcctccgttagtggcggagaaggagccggaggaccagcgcctttcttggtgaaaacctacgagatggtcgacgattcatcaacggaccagatcgtatcgtggagcgctaacaacaacagcttcatcgtttggaatcatgccgaattttcacgcctccttcttccaacctacttcaaacacaataacttctcttccttcattcgtcagctcaatacctatgggtttaggaagattgatccagagaggtgggagtttttgaatgatgattttattaag

SEQ ID NO: 155 - DNA, 410 bp, Arabidopsis thaliana
acaggaagaggtttcttctccatttattgcatttgtctctccaaaatgtctaattaatggttttgatcttccaaccagatcttcttctctatctcttcgacaaacccttttttctgggttcttcggagaggtgatttatcaccaaaaaaaagattttaaaagtctaaatccttttttctttctttccttcaacatgcctttaccttggaagaaatctaaatctagtcggatctctagattcgtatcagactttcaacaatctcctaaacatggtggatctctcgttgttgaaactggtttcccaacttctttaatcgatctctttgttaagaatcgcgatcgtctcaaaaaacaatcttcaaaacgtaacaacaagaacaacaaagcccagactgaaacgcgtgttttgt

SEQ ID NO: 156 - DNA, 396 bp, Arabidopsis thaliana
acaaacccttttttctgggttcttcggagaggtgatttatcaccaaaaaaaagattttaaaagtctaaatccttttttctttctttccttcaacatgcctttaccttggaagaaatctaaatctagtcggatctctagattcgtatcagactttcaacaatctcctaaacatggtggatctctcgttgttgaaactggtttcccaacttctttaatcgatctctttgttaagaatcgcgatcgtctcaaaaaacaatcttcaaaacgtaacaacaagaacaacaaagcccagactgaaacgcgtgttttgtctccacctcctcctcatatgtctttgcagcgtcgtatgtctcttccttccaagcttgatccagctttggttacagaggattctcc

SEQ ID NO: 157 - DNA, 371 bp, Arabidopsis thaliana
gatgaaactaccaaagattgtactgcttatttttgtgtcaggaaagattgatataactggagccaagatgagagaagagacttatgccgcataagagaatatctacccagttcttagagaattcatgaaggtccagtaataatagtatatacgaccatagtgaaggcaaaaaccatgttcacgtgtgaattggcatgaactagagatctcgggtgttggcaggcgcttggtggggtgagtattccttggacaagaacttgaaattattcagattcaaaaccagaaattgtaaatagataatggagatgccaataaatctcttttcttttttggtctaaaaatgtcttccaagtaatcttggttcatggtct

SEQ ID NO: 158 - DNA, 424 bp, Arabidopsis thaliana
aggaggaaggtgacgaaagaatccattgaagtgatagctcagagcattggactctccactctttctccggacgtctcagccgctcttgctcccgatgtcgagtatcgcgtccgagaggtcatgcaggaagctatcaaatgcatgcgtcatgctcgacgcaccactttaatggctcatgatgtcgattctgctcttcatttcaggaatttggagcctacctctggctccaaaagtatgcggttcaagagagctcctgagaacagagatctatacttcttcgatgacaaagatgtcgagctcaagaatgttatcgaagctcctctaccaaatgcacctcctgatgcatctgttttctctcattggttggcaattgatggtattcaaccttccattccacagaattctcctctccaagccatatctg

SEQ ID NO: 159 - DNA, 428 bp, Arabidopsis thaliana
aaagaaagaaggcgcaaggaggatggtgacgaaagaatccattgaagtgatagctcagagcattggactctccactctttctccggacgtctcagccgctcttgctcccgatgtcgagtatcgcgtccgagaggtcatgcaggaagctatcaaatgcatgcgtcatgctcgacgcaccactttaatggctcatgatgtcgattctgctcttcatttcaggaatttggagcctacctctggctccaaaagtatgcggttcaagagagctcctgagaacagagatctatacttcttcgatgacaaagatgtcgagctcaagaatgttatcgaagctcctctaccaaatgcacctcctgatgcatctgttttctctcattggttggcaattgatggtattcaaccttccattccacagaattctcctctca

SEQ ID NO: 160 - DNA, 412 bp, Arabidopsis thaliana
tttaatctcaagctcataggaatttgatctccacattatatcttgatcatcaccacaagaaaaacatttcaacttcttttatcagcaatcacaaatcaaagagatgggaagagctccatgctgtgagaagatggggttgaagagaggaccatggacacctgaagaagatgaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccatatacttggcaatagatggtcagcgattgcagcagaactgcctggaagaatcgataacgag

SEQ ID NO: 161 - DNA, 393 bp, Arabidopsis thaliana
accacgcgtccgcccacgcgtccgcccacgcgtccgatttgatctcaagctcataggaatttgatctccacattatatcttgatcatcaccacaagaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccagatac

SEQ ID NO: 162 - DNA, 362 bp, Arabidopsis thaliana
ggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcacgaaaagtgcaaaacttgaga

SEQ ID NO: 163 - DNA, 282 bp, Arabidopsis thaliana
ggtcttactccaagaattggcttgacgccatcaagggatgggtcttctttttctatgacacccaaagggactcccttcagggatgaacttcacattaacgaagacatggacatgcacgaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagac

SEQ ID NO: 164 - DNA, 390 bp, Arabidopsis thaliana
cccacgcgtccgggctcatccaacagctcttctacgtgctctgatgaaggaaatgttgaaatcatggagagaaggaggatagagatggagaagaagaagaaaagaagagctgttactgtggtagcaatggaagaagataacttgaaagatgatgatgctcatagacttactctgaatcttggtggtaataatattgaggggaatggtgtgaaaaagacgaaacttggaggagggattccgagtcgggcgatttgttgtcaggtagacaactgtggagctgatttaagcaaagttaaggattatcatagacgtcataaggtctgtgagattcattctaaagctactactgcacttgttggaggaattatgcagcggttttgtcagcaatgt

SEQ ID NO: 165 - DNA, 347 bp, Arabidopsis thaliana
cccacgcgtccgggctcatccaacagctcttctacgtgctctgatgaaggaaatgttgaaatcatggagagaaggaggatagagatggagaagaagaagaaaagaagagctgttactgtggtagcaatggaagaagataacttgaaagatgatgatgctcatagacttactctgaatcttggtggtaataatattgaggggaatggtgtgaaaaagacgaaacttggaggagggattccgagtcgggcgatttgttgtcaggtagacaactgtggagctgatttaagcaaagttaaggagtttcatagacgtcataacgtctgtgagattcagtccaaagctactac

SEQ ID NO: 166 - DNA, 342 bp, Arabidopsis thaliana
  unsure (1)..(342): unsure at all n locations
cacatggaagagaacaacaacgacaagatcaagaaaagacaaagatttgtaagaaaatgggaagagctccatgctgcgacaaggcaaacgtgaagaaaggaccatggtcaccggaagaagatgtgaagctcaaggattacatcgacaaatatggcactggtggcaactggatcgcactgcctcagaaaattgggctgaagagatgtggtaagagttgcagactgagatggcttaattacttaagaccaaacatcaaacatggtggtttttctgangaagaagatagaatcatcttgagtctctaaattagcattggaagccggtggtccataattgcagctc

SEQ ID NO: 167 - DNA, 416 bp, Arabidopsis thaliana
gaatatatctcttcctctgtttcttcgccattctctcagcttttctccttcttcttcgtctttgtcagagtgaatggagctgtggacagaagctagagccttaaaggcaagtctaagaggagaatctactatatctctcaaacatcaccaagtgattgtgtcggaagatttaagccgaacttcttccttgccggaagatttctccgttgagtgtttcctcgatttctcagaaggtcaaaaagaagaagaagaagaagttgtctctgtttcttcttcacaagagcaagaagaacaagaacatgattgtgtctttagttcacaaccttgcatctttgatcaacttccttctttgccggatgaatatgtggaagagcttgaatgggtatcccgtgttgtggatgattgttcatcaccag

SEQ ID NO: 168 - DNA, 436 bp, Arabidopsis thaliana
cccacgcgtccgcccacgcgtccggttaagaaatatcatagtaatgacaaccgtgataaggacaatactggtttgggcgatggtgataaggacaatacttgtaagggggatgatgataaggaaaaatctggtagtggcggttgtgagaaggaaaatgaagggaatggcggaagtggtaaggacaataatggtaatggcgattctcagcctgcggagtgttcaactggtcagaagcaggttgtctgcaaagaaattggttgtggaaaagcctttaagtatccttcacagcttcaaaagcatcaggattctcatgtgaaattagactctgtggaggcattttgttccgagcctgggtgtatgaagtactttaccaacgaagaatgcctcaagtcacacataagatcctgtcatcagcacatcaactgtgagatatgtg

SEQ ID NO: 169 - DNA, 410 bp, Arabidopsis thaliana
cacacgcgtcagcccacgcgtccggaatgaatctctgtttcttgttttggaaccgagatggcttcctaacaattgggcttttctctgcctcttcctaggaatctgaagctcttctctactctctactctatcactccatctgtgaacatatctttcttattcttctaggcactatctatttttcactttttgtaattggaatttggagatggctatgcaaactgtgagagaaggtctcttctctgctccacagacttcttggtggactgcttttggatctcagccgttggctccggagagtctcgccggcgattctgactcattcgccggagttaaggtcggatctgtcggagagacaggacaacgtgtggataaacaaaacaactctgcaacgcacttagctttctcac

SEQ ID NO: 170 - DNA, 427 bp, Arabidopsis thaliana
gtgaatgaatctctgtttcttgttttggaaccgagatggcttcctaacaattgggcttttctctgcctcttcctaggaatctgaagctcttctctactctctactctatcactccatctgtgaacatatctttcttattcttctaggcactatctatttttcactttttgtaattggaatttggagatggctatgcaaactgtgagagaaggtctcttctctgctccacagacttcttggtggactgcttttggatctcagccgttggctccggagagtctcgccggcgattctgactcattcgccggagttaaggtcggatctgtcggagagacaggacaacgtgtggataaacagagcaactctgcaacgcacttagctttctcacttggtgattgtaagagtccaagacttgtgccaaagcctc

SEQ ID NO: 171 - DNA, 412 bp, Arabidopsis thaliana
caacaatggacgtctacggcatgtcttcaccggacttgcttcgtatcgacgaccttctcgatttctccaacgacgaaatcttctcttcctcttccaccgtcacttcctccgccgcttcctccgccgcttcttccgaaaaccctttcagctttccttcttccacctacacttctcctactctcctcaccgacttcactcacgatctctgcgttcccagtgacgacgcagctcatctcgaatggttatcgcgattcgttgacgattcattctccgatttcacagcaaatcctttaaccatgaccgttagacccgagatttcattcaccggaaaacctagaattcgccgatcaagagcaccagcaccttccgtagctggaacttgggctccgatgtctgaatcaaagctttgtca

SEQ ID NO: 172 - DNA, 397 bp, Arabidopsis thaliana
ctcgctgtccctccttctctttctcattcattgcaatgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggggttccatggacggcggaagagcaccggacgtgtctaattggattagaaaagcttggaagaagagattggagaggaatctctagaaacttcgt

SEQ ID NO: 173 - DNA, 393 bp, Arabidopsis thaliana
agttataaataaaaatttattttattttcctgaatagcttaagagaaatttgatcttcgtcttcgtcactacgtccccagctctcgagctttgggcactcgatttcctctatacatttccttaaaacccaaaattcttaagcctaatccaaaggagaaaaaaacagagcatttttcttcttctccaatttaaacagtttcctaataatctcactttgtctactcgattctcccaactccaatttgactcatcggaatcatgccattatcaatgaatcctccgacgaatccgccaccattgttccgttgcatctccgtcatgtaactcctcacttccgccttaatcatctcttgcaccaccgccataaactcgcctccgttaccgggaaaagac

SEQ ID NO: 174 - DNA, 383 bp, Arabidopsis thaliana
gaggcaagcaaccaaatctcagagacaattataacagtatagagaaggaagaaagaaaagaaaaagaaaccgttgttgatttagatacagagaagagaagatcatctaacatgggaagatctcctatctctgatgactctggtctcaagaaaggtccttggactcctgatgaagatgagaaacttgtcaactatgttcaaaaacatggtcatagtagctggagagcccttcccaaactcgctggtcttaacaggtgtgggaagagttgcaggctaagatggacgaactacttgagaccagacatcaagagagggagattctctccggacgaggaacagactatcttgaatcctcattcagttcttgggaacaagtggtcaacg

SEQ ID NO: 175 - DNA, 457 bp, Arabidopsis thaliana
ggatggccgtgatgagcctgagagaggaaactctaatcagcagtttacgcaggatttatttgtgccatcttctgggaaactaaaacgtgatgattcatctgcacactatcaaaatggtggatctatacctcaacaagatggtgcaagcgatgctatccctgaggcaaactttgaatgtgctgcactccgtataacctatgttggcgatagaaagatcccacgagatttgattggctcatcatcgaagattctccaagttgatgggccaatgcctgacccgtatgatgaaatgttgtccacacccaatatatacagttttcaaaggaccaatgacaagtttaatgatggcaaaactcctggtccaaacgaaatccaaacgagcactcctgttgctgtaccaaacgatatcattgaagatgatgaagagctgttgaaccaagatgatgatgatgacgag

SEQ ID NO: 176 - DNA, 416 bp, Arabidopsis thaliana
  unsure (1)..(416): unsure at all n locations
ctttgagagagagagcaaatgaaaaaaacccaaaaaactcttttctccaaccattaccatctcatgaacactctcacaggaggctctctcttctcagagagcctacccatctaatatttcttcatctgagtctcttttacttctctcaaagtatcgatctttattcttctttttgtaaaccctctctctctctctgatttctactgacctgtttggaagatatgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcncattctctgtaacatcgagcctcgacag

SEQ ID NO: 177 - DNA, 421 bp, Arabidopsis thaliana
  unsure (1)..(421): unsure at all n locations
atctcctttgagagagagagcaaatgaaaaaaacccaaaaaactcttttctccaaccattaccatctcatgaacactctcacaggaggctctctcttctcagagagcctacccatctaatatttcttcatctgagtctcttttacttctctcaaagtatcgatctttattcttctttttgtaaaccctctctctctctctgatttctactgacctgtttggaagatatgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcncattctctgtaacatcgagcctcgacag

SEQ ID NO: 178 - DNA, 386 bp, Arabidopsis thaliana
attttcctctctcttctctctcttctctctcttctctctacttagctgcctcgcttttgctccttttacctctttccatctttcaatctcctttgagagagagagcaaatgaaaaaaacccaaaaaactcttttctccaaccattaccatctcatgaacactctcacaggaggctctctcttctcagagagcctacccatctaatatttcttcatctgagtctcttttacttctctcaaagtatcgatctttattcttctttttgtaaaccctctctctctctctgatttctactgacctgtttggaagatatgatggctcatcactccatggacgatagagactctcctgataaaggatttgattccggcaagtacgttagatac

SEQ ID NO: 179 - DNA, 458 bp, Arabidopsis thaliana
gcgaaagatcaactcaaaatcaatggattatctcggaatcgacatgagctgcgcgatcggatctctccggaacggtgacttcccggagaaagattgtcttcttcctctaatttcaaagcttctcggttattgcctcgttgctgcttcaatcaccgtcaagctccctcagataatgaaaatcgttcaacataagagtgtacgaggcttaagtgttgtggcatttgagcttgaagttgttggttacacaatttcacttgcctattggttgcataaaaggcttcccttttccgctttcgggcaaatggcttttcctttgattcaagctttaatcctggtggcttgtaactattaatattcacaaccaatacctgtcacaacttggattaaaccacttccatattgcgctgtggcgccaactgtgcttgctggacaaattaatccgacgcttttcgaagctc

SEQ ID NO: 180 - DNA, 388 bp, Arabidopsis thaliana
ctctgctcagcttttccgaccaaaagatccaagcgcaagatcaactcaaaatcaatggattatctcggaatcgacatgagctgcgcgatcggatctctccggaacggtgacttcccggagaaagattgtcttcttcctctaatttcaaagcttctcggttattgcctcgttgctgcttcaatcaccgtcaagctccctcagataatgaaaatcgttcaacataagagtgtacgaggcttaagtgttgtggcatttgagcttgaagttgttggttacacaatttcacttgcttattgtttgcataaaggtcttcccttttcggctttcggcgaaatggcttttcttttgatccaagctttaatcttggtggcttgtatctattattatt

SEQ ID NO: 181 - DNA, 327 bp, Arabidopsis thaliana
agaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaaggaagacgttatgatgcatcagatgttgaataagaaagattcagctactcattccactttgccataccttaatactagcatctcttggggagtggttccaactga

SEQ ID NO: 182 - DNA, 413 bp, Arabidopsis thaliana
agatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaaggaagacgttatgatgcatcagatgttgaataagaaagattcagctactcattccactttgccataccttaatactagcatctcttggggagtggttccaactgattccgttgctaatcgtcgcggttctgctgaatcactaagcttgaaggttgattcaagacctgggcatatacaaactacaaagcaaatcagttttcaagaccaagattcatcttcaacacagtccactggtcaatcttatactgaagttg

SEQ ID NO: 183 - DNA, 436 bp, Arabidopsis thaliana
ccaaaacaaggaacaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaacgaagacgttatgatgcatcagatgttgaataagaaagattcagctactcattctactttgccataccttaatactagcatctcttggggagtggttccaactgattccgttgctaatcgtcgcggttctgctgaatcactaagcttgaaggttgattcaagacctgtgcatatacaaactacaaagcaaatcagttttcaggaccaagattcatcttcaacacagtccactggtcaatc

SEQ ID NO: 184 - DNA, 392 bp, Arabidopsis thaliana
cagagtcttcgtctgcaagagagaacaataccactcaatcataatctataacaatggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccagtgatgacgcagctcatcttgaatggctttcgcaattcgtggacgattctttcgctgattttccggcgaatccattaggaggaactatgacttctgtcaaaactgaaacttcctttccgggg

SEQ ID NO: 185 - DNA, 389 bp, Arabidopsis thaliana
tttcattttgtttcattttcttatctcctcacactcttcgaacaaggaagaaccctaatctcaagatgaatagggagaagttgatgaagatggctaataccgtccgcactggcggaaagggtactgtcagaagaaagaagaaggctgtgcacaagaccaatacaactgatgacaagaggcttcaaagcactcttaagagaattggagttaactccattcccgctattgaagaagttaacatctttaaggatgatgttgttattcagttcatcaaccctaaggttcaagcttcaattgctgcaaacacatgggttgttagcggttctcctcagaccaaaaaattgcaagatatccttcctcagatcatcagccaacttggaccaaacaac

SEQ ID NO: 186 - DNA, 370 bp, Arabidopsis thaliana
agtttcttttcgttttgtttcactttcttatccccgcacactcttcgaacaaggaagaaccctaatctcacaatgaatacggagaagttgatgaagatggctaataccgtccgcactgacggaaagggtactgtcacaagaaagaagaaggctgtgcacacgaccactacaactgatgacaagaggcttcaaagcactcttaagagacttggagttaactccattcccgctattgaagaagttaacatcgttaatgatgacgttgttagtcagttcatcaatcctaatgttcaagcttcacttgctgcaaacacatgggttgttagcggttctccgcagaccaaaccattgcaagatatccttcctcaga

SEQ ID NO: 187 - DNA, 417 bp, Arabidopsis thaliana
  unsure (1)..(417): unsure at all n locations
cacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctanggagcaagtaacanaacaacccttcacgatacaagaggagacagc

SEQ ID NO: 188 - DNA, 359 bp, Arabidopsis thaliana
agttgacgtggtttcgggttctagaagatatggatctgagaactggatgtcctcagccaggcatgaacctacttacacagatttgctctccggctttgggactaacatagatccatcccatggtcagcggatacctttttatgaccattcaccagcaccttctatgcctgcagagagaatcttgagtgattcacagtgcaagttcgattaccttgttaaccaatggcagatgatacactcaggtctctcgctgaagttacaggaaccccctaaggtacctgcatgaactgatgcttccctccaaaggcgatgcaatgttaaatacacctactatcctgttcgtaatggtctagcgactg

SEQ ID NO: 189 - DNA, 414 bp, Arabidopsis thaliana
caatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaattacagcgaatatcctgttcttaatggtctatcgactgagaatgctggtgggaactggccaatacgtcca

SEQ ID NO: 190 - DNA, 413 bp, Arabidopsis thaliana
tacaactgcaagaagacgacagaagggggatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaggatgtgcgtatgatctccgccgaagcaccgaatctcttcgcgaaagcttgtgagcttttcattctcgaacttacga

SEQ ID NO: 191 - DNA, 370 bp, Arabidopsis thaliana
tacagctgcgagaagacgacagaagggggatcttttgatccattcacaaggcagtgatccactggacaatcacaacggcaacatccagcatccagcactcaagtccgtctatcgacctgggtccaccgtcagaagcgtaatcgctcctccatgatctggatctgcatcaatattcaccggatgaggaccgacatagtaccacctcctccagcagcaacatcagcagcttcatctgttctggacagaccacagacaagagatcgaacaggtaaacgatttcaagaaccatcagctctctctaggtcgtatcaggaaaatcatgacagctgatgaagatgtgcgtacgatctccgctgaagcaccggttctc

SEQ ID NO: 192 - DNA, 417 bp, Arabidopsis thaliana
aatcatacgcgcttccatcaaccctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaa

SEQ ID NO: 193 - DNA, 444 bp, Arabidopsis thaliana
atacgcgcttccatcaaccctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtccttgcctggagcgaaaacaacaaaagcttcatcgtcaagaatccagcagagttttc

SEQ ID NO: 194 - DNA, 452 bp, Arabidopsis thaliana
cccacgcgtccgcccacgcgtccgcccacgcgtccgcccacgcgtccggttctagatcgcgagcggccgcccttttttttttttttttttttttttttttttttttttttttatttttttttttttttttttttaaaaccaaataatctgcgaatcaaattttaagttgtaaatgttagaatttccgattcacttgcatgacacaaagagcactagtcattgatttgatgtaagaatacactgaaatttggtacaatcaaaagcgaaagagttttatggtttaaggtgttgggggctttttggattgaaattagaatctcccaaggttcccttcgctgtgtgcagttgtatcaatatagccaaaaaaaaaatctgtatgactaaaaagccagctcgtgctttcttaacctacttgtcacgccggtccttggggagtaaatcagccttcctca

SEQ ID NO: 195 - DNA, 440 bp, Arabidopsis thaliana
ctcttggttcttttccataagcttataacatatattttttttaaaatctactctgcgttaaaaaaatgaaaacacgtagcagcagtgtgggtaagatcaaagggtgtttctcgatcagtttcatattcagatgtatcagagttctcattaacagatctgtttctttttccttatctgattaaacaatttccttcagaattttacttttttgaacatatatagtttttctctgttcctatatcttgagttttgtgagaggttaattatatgaaattttacgcattattgttcatctatatcgaaaaacaatgtcaagaaagccatgttgcgtcagagaaggcttgaagaaaggagcatggaccaccgaggaggacaagaaactcatctcgtacatccacgaccacggcgagggatgctggcgcgacattccccaaaaagct

SEQ ID NO: 196 - DNA, 421 bp, Arabidopsis thaliana
atcagtttcatattcagatgtatcagagttctcattaacagatctgtttctttttccttatctgattaaacaatttccttcagaattttacttttttgaacatatatagtttttctctgttcctatatcttgagttttgtgagaggttaattatatgaaattttacgcattattgttcatctatatcgaaaaacaatgtcaagaaagccatgttgcgtcggagaaggcttgaagaaaggagcatggaccaccgaggaggacaagaaactcatctcttacatccacgaccacggctagggatgctggcgcgacattccccagaaagctgggttgaaacggtgtggaaagagttgtagaacgcaatggaccaactaccttaaacctgagatcagaagaagcgattttagttcagaggaagagc

SEQ ID NO: 197 - DNA, 423 bp, Arabidopsis thaliana
caggaagtgttcaaaggaacgaaatacacttcttcttccatttgatgtctgtggtccgaatgaaaaatatctctgtattaaccagaaacgtgtttcataagcatctttaactcttcagctctcaaattcttcatgaatatctctgcttatcgatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgttacttcctctattattcaggttgatcctagaattgatgatcacaacaacaacatcaagataaattatga

SEQ ID NO: 198 - DNA, 451 bp, Arabidopsis thaliana
aacggacgcgtgggcggacgcgtgggctgatctcctcttctctctgtcttctgagttctgtctacgcttcgtcgccgatcccggccagactccgtcttaccggcacaaaccctagattcccggaggacgaaattcgttttttcgccggaactaaattaaggagatttgagaggctatgggtacaacaacgacaacaagcgctgtgtatatccatgttatcgaggatgtcgtcaacaaagttcgtgaggagttcattaacaacggaggtcctggcgagagtgttctcagcgagcttcaaggaatttgggagacgaagatgatgcaagccggagtcttgaatggaccaatagagaggtcatcggctcagaagccaacacctggtggtccactgactcatgatttgaatgttccttatgaaggtacagaggagtacgagactcccactgctgaa

SEQ ID NO: 199 - DNA, 385 bp, Arabidopsis thaliana
atatataaaaaaaaaaaagtgagagagagagcaaatctgtgtgatggaagttgctcttgagtttgggattatttatcttttcaatatcatttgatgaagaaggatggtgagatgggaagaagtgatgtcaggaggagtaggagatgaaagagagacaacgttggagtggtgaagaagatgcattgttacgtgcttacgttagacagttcggtccgagagaatggcatcttgtgtctgagcgtatgaacaaacctttgaaccgtgacgccaagtcttgtttagagagatggaagaattatcttaagccagggatcaagaaagggtctttgacagaggaatagcagaggcttgtgatccgtcttcaggagaaacacgggaacaagtg

SEQ ID NO: 200 - DNA, 373 bp, Arabidopsis thaliana
aaaaaaaaaagtgagagagagagcaaatctgtgtgatggaagttgctcttgagtttgggattatttatcttttcaatatcatttgatgaagaaggatggtgagatgggaagaagtgatgtcaggaggagtatgagatgaaagagagacaacgttggagtggtgaagaagatgcattgttacgtgcttacgttagacagttcggtccgagagaatggcatcttgtgtctgagcgtatgaacaaacctttgaaccgtgacgccaagtcttgtttagagagatggaagaattatcttaagccagggatcaagagagggtctttgacagaggaagagcagaggcttgtgattcgtcttcaagagaaacacggcaaca

SEQ ID NO: 201 - DNA, 443 bp, Arabidopsis thaliana
gttactcttgagtttgggattatttatcttttcaatatcatttgatgaagaaggatggtgagatgggaagaagtgatgtcaggaggagtaggagatgaaagagagacaacgttggagtggtgaagaagatgcattgttacgtgcttacgttagacagttcggtccgagagaatggcatcttgtgtctgagcgtatgaacaaacctttgaaccgtgacgccaagtcttgtttagagagatggaagaattatcttaagccagggatcaagaaagggtctttgacagaggaagagcagaggcttgtgatccgtcttcaggagaaacacggcaacaagtggaagaagattgctgctgaggttcccgggaggacggcaaagcggttaaggaagtggtgggaagtgtttaaggagaagcaacagagagaagagaaagagagtacaagag

SEQ ID NO: 202 - DNA, 382 bp, Arabidopsis thaliana
ttcttcccaacacacacaaaaaaaaaaaactgtaacgaccaaaaaaaaagaggacgcgttagaagaaaaaaaaagaacaatccgataaaaagatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctcacgtcttctc

SEQ ID NO: 203 - DNA, 419 bp, Arabidopsis thaliana
  unsure (1)..(419): unsure at all n locations
aacacacacaananaaaaaaactgtaacgaccaaaaaaaaagaggacgcgttagaagaaaaaaaaagaacaatccgataaaaagatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacg

SEQ ID NO: 204 - DNA, 421 bp, Arabidopsis thaliana
aacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtg

SEQ ID NO: 205 - DNA, 424 bp, Arabidopsis thaliana
tacggctgcgagaagacgacagaaggggaaccaaaaagcttttcttcccaacacacacaaaaaaaaaaactgtaacgaccaagaaaaaagaggacgcgttagaagaaaaaaaagaacaatccgataaaaagatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctccgtttggtaacaagtgggctacgatctcgcgtcctctcaat

SEQ ID NO: 206 - DNA, 417 bp, Arabidopsis thaliana
accacgcgtccgcaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgtttcatggttcgcagaatcttcatatacacgaaagaggaagtgaggaagaatacccggggac

SEQ ID NO: 207 - DNA, 427 bp, Arabidopsis thaliana
cccacgcgtccggtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaaacaaacaaaataaccaacaacccttttgctgcaagccgaggatgggggtcgattggtggagactggagagcaaaatggg

SEQ ID NO: 208 - DNA, 387 bp, Arabidopsis thaliana
gagtcttttagtctgatctcttacaagaatggcgttcgcaggaacaacccagaaatgcatggcatgtgacaaaacagtttatcttgtcgacaagttaaccgccgataaccgggtccaccacaaagcttgtttccgatgtcaccattgcaaaggaactctcaagcttagcaattacaactcctttgaaggagttctctactgcagaccacatttcgatcaaaacttcaagagaactggaagtcttgagaaaagcttcgaagggacaccaaagattgggaaacctgataggcctttggagggagagagacctgctggaaccaaagtttcgaatatgtttggtggaacacgagagaaatgcgttggttgcgacaaaaccgtgtatccaat

SEQ ID NO: 209 - DNA, 392 bp, Arabidopsis thaliana
aagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaaggttgagctatggaacca

SEQ ID NO: 210 - DNA, 418 bp, Arabidopsis thaliana
ctcccttactaaatttccttctctaatctctactttgtccaaaagcatttaactttaacgggaaaaatcttatatttgtttcctcctggatctctctctctatatctgcagattcacactacagctgatttagatctatttcgtaagtgggtctttcaaagtcgtctcctttgatctactttgattcaagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatactt

SEQ ID NO: 211 - DNA, 423 bp, Arabidopsis thaliana
atttggtgataagtcagtagaaatggataaggagaaatctccagcacctccttgtggaggtcttcctcctccatctccatcaggccgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagac

SEQ ID NO: 212 - DNA, 436 bp, Arabidopsis thaliana
cactctttctctctctctctctggttccctagaatttgagcaaaatttctaccataattgctaattattaaaaggaaacataagtaatcgttgcttcgatcctttgttacatggatggatcctgaacaggaaatctcaaacgagactttggaaactatattggtaagttcaacaaaaggaagcaataataacaataagaaaatggaagaagaaatgaagaagaaagtatcaagaggagaattaggaggtgaagctcaaaattgtccaagatgtgaatctccaaacacaaagttttgttactacaacaactatagtctctcacaacctcgttacttctgcaaatcttgtcggagatattggactaaaggcggtactcttcgtaacgttcccgtcggtggtggttgccgtcgaaacaaacgattctcttcctcagctt

SEQ ID NO: 213 - DNA, 375 bp, Arabidopsis thaliana
cacgtgttttgttttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatcatgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgatcccaatcgtgtcggtggtccaaccaacccgcttct

SEQ ID NO: 214 - DNA, 408 bp, Arabidopsis thaliana
agattttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatcatgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgatcccaatcgtgtcggtggtccaaccaacccgcttctcgctgatagtgctttaaccactgttaccgctaagcccaatg

SEQ ID NO: 215 - DNA, 422 bp, Arabidopsis thaliana
catctctcgtgttttgttttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatcatgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgattccaatcgtgtcggtggtccaaccaacccgcttctcgctgatagtgctttaaccactgttatcgctaagcccaaatg

SEQ ID NO: 216 - DNA, 407 bp, Arabidopsis thaliana
actcatgttttgttttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatcatgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgatcccaatcgtgtcggtggtccaaccaacccgcttctcgctgatagtgctttaaccactgttatcgct

SEQ ID NO: 217 - DNA, 355 bp, Arabidopsis thaliana
aggacgcgtgggcggacgcgtgggcgatcacctaagatccgatccgcgagcgtttcagacttcgatcagatccgattaagagaagcatatcaggtcgggtatgactcgtcgatgttctcaatgcactcacaatggccacgcctctcggacttgtcccaaccgcggcgtgatgctctttggtgttcggctcagcgaaggttcgatccggaaatgtgcaagtatgggtaatcttagccattacacgggttctggatcgggtgggcttggaaccgggttaaaaactccgggttctccgggtgatgtcactgaccatgtcgctggtgagggttactcgtctgaggatttctttgctggc

SEQ ID NO: 218 - DNA, 405 bp, Arabidopsis thaliana
atgtgcttcttctgcgatcaactaagatccgatccgcgagcgtttcagacttcgatcagatccgattaagagaagcaaatcgggtcgggtatgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttccccgggtgatgtccctgaccatgtcgctggtgatggttacgcttctgaggatttccttgctggttcttcctcaagccgcgagagaaagaaatgaactccatgggcagaggaagaacacaggatg

SEQ ID NO: 219 - DNA, 386 bp, Arabidopsis thaliana
accacagaaagggagctcaagcttctacgtcatcttcgacatgagaatgtggttgctcttaaagatgtaatgatggctaatcataagagaagctttaaggatgtttatcttgtttatgagcttatggatactgatcttcatcagattattaagtcttctcaagttcttgcaattgacgattttgatgaaaatgagctccaagaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaggtgttgctgggaacgcggacaaagttgcagcttt

SEQ ID NO: 220 - DNA, 411 bp, Arabidopsis thaliana
aagagaatggcaactttgaaccggtcaagaaatatacaattcggaattttccgacagagactttggccaaaatggtcaaaaccggtaccctaacccttaaccaaccaacccagttcctggtacaatttgacagctcaatgactgaactctctggagagccatgtgaagaccagtgtgtccatcaggggacacctgcacacttacaggttctgtgacaatgtctggaccttcatattacaggacgcaatgttcaagagtgacgatcgtcaagagaatgtgacccgggtgaagatagtggcatgtgattcgaagctgctcacacagtgaagatgcaaattgtctgcagggaatttaccttccctttgtactagatttttgagttctctcacctttgtaaactcagcacttgct

SEQ ID NO: 221 - DNA, 439 bp, Arabidopsis thaliana
cagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagagagcttgttccgatgccgtcaaccctccttccgtcaccgaagctaatactcagtactatcagcaagaagct

SEQ ID NO: 222 - DNA, 419 bp, Arabidopsis thaliana
cagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactc

SEQ ID NO: 223 - DNA, 436 bp, Arabidopsis thaliana
cggacgcgtgggttcccatcctcacttctctttctttctgatcataattaatcttgctaagccagctagggcttatagaaatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaaactaatactcagtactatcagcaagaggggtctaaactccggagacagattcgggacat

SEQ ID NO: 224 - DNA, 420 bp, Arabidopsis thaliana
  unsure (1)..(420): unsure at all n locations
accacggacgcgtgggttcccatcctcacttctctttctttctgatcataattaatcttgctaagccagctagggcttatagaaatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcangaggcgtctaaactc

SEQ ID NO: 225 - DNA, 412 bp, Arabidopsis thaliana
  unsure (1)..(412): unsure at all n locations
gaaatcttgagaactcaggatcaatggaggaaggtgggagtagtcacgacgcagagagtagcaagaacctaaggagagggaaaatagagataaagaggatagagaacacaacatatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcanataggcatattgttggggaatc

SEQ ID NO: 226 - DNA, 426 bp, Arabidopsis thaliana
  unsure (1)..(426): unsure at all n locations
atccatacctttcnttcttcatcttcatcttcacgcagcgacttctttgattctctctttttattctcagctccaatttcaacctgcatttctctcttctcaattttgggtttctttttttgatatctcatttgatcagatcgacgaagagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaactgagcaattattcatcaatggaacgagtggtgtattgtaggcctcattttgagcagcttttcaaggagtctggtagtttcagc

SEQ ID NO: 227 - DNA, 390 bp, Arabidopsis thaliana
aatattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaacgagaaaggaagttacagtcatctcatcaaatctgcttccatcaaacgcgctactgctg

SEQ ID NO: 228 - DNA, 456 bp, Arabidopsis thaliana
gttaaaacgtgttgatggtttctgaacagctgagcaattattcatcaatggaaggagtggtgtattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgcgctaatgctgctgcta

SEQ ID NO: 229 - DNA, 438 bp, Arabidopsis thaliana
attttctattgcagagagaaagagagttagagaaagagagagagagagagagagagagagagatgaaacttgtgcaagaagaataccgtaaaggaccgtggacagaacaggaggacatcctcttggtcaactttgtccacttgttcggagatcgaagatgggattttgtagcgaaagtttcaggtttgaaggtggagggagaaacataagaataggtttaaacaaaacaggaaagagttgcaggttaaggtgggttaattacctgcatcctggtctcaaacgtggtaagatgactccacaagaagagcgtttagtccttgagcttcacgccaaatggggaaacaggtggtcaaaaattgcccgggaattaccggggagaacagataatgagataaagaactactggacgactcatatgaggaagaagctcaagagaag

SEQ ID NO: 230 - DNA, 424 bp, Arabidopsis thaliana
cccacgcgtccgcaacccttcaaaaagagaaaagatctaaagaataaacaagagccctaatatcaaatcacaaccaaaaaaaccaaagaaagctaattaaagttttctctctagctattcctcttcttttcttgttcttgaaaactagggtttacttcaccaaaagataagatctttccccagaaaaagcaatacccaagtcatgtttctgtgtgtctgtatatagataaaacattacataccctaataaggttacacaaatagctataaaagagggaaaataagatagggattttttggggtgaggaaagatgggaagaggaagagtagagctcaagaggatagagaacaaaatcaacagacaagtgacgtttgctaaacgtagaaatggtttgctgaaaaaagcttatgagctttctgttct

SEQ ID NO: 231 - DNA, 393 bp, Arabidopsis thaliana
cggacgcgtccgcccacgcgtccgcccacgcgtccgttttgctctcaatagattccattgattcaaaacaaaattttcattaagatttcacaacctccacacacttccaaacacaattaaagagaggaaaaagaatcaataaccctataaataaaaaatcagacaaacagaagtttcctcttcttcttccgtaagctagtaccttttgttcttgaaattagggttaatttcttttttccaaataccatcaattctccagaccataaaaactcaaaaagatcagatctttcctctgaaaaagagatacccaacttatgtttttgtgtgtctgtatatagatagacattacatacccatatttgtgtagagacataaaaagtggcaattaaggta

SEQ ID NO: 232 - DNA, 422 bp, Arabidopsis thaliana
  unsure (1)..(422): unsure at all n locations
aaacccttcaaaaagagaaaagtctaaagaatanacaagagccctaatatcaaatcacaaccaaaaaaaccaaagaaagctaattaaagttttctctctagctattcctcttcttttcttgttcttgaaaactagggtttacttcaccaaaagataagatctttccccagaaaaagcaatacccaagtcatgtttctgtgtgtctgtatatagataaaacattacataccctaataaggttacacaaatagctataaaagagggaaaataagatagggattttttggggtgaggaaagatgggaagaggaagagtagagctcaagaggatagagaacaaaatcaacagacaagtgacgtttgctaaacgtagaaatggtttgctgaaaaaagcttatgagctttctgttctctgcgatgctg

SEQ ID NO: 233 - DNA, 416 bp, Arabidopsis thaliana
cagacgcgtgggcttttgttcttgaaattagggttaatttcttttttccaaataccatcaattctccagaccataaaaactcaaaaagatcagatctttcctctgaaaaagagatacccaacttatgtttttgtgtgtctgtatatagataaacattacatacccatatttgtgtatagacataaaaagtggaaattaaggtaacaaaaagaaatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttga

SEQ ID NO: 234 - DNA, 393 bp, Arabidopsis thaliana
aagatttcacaacctccacacacttccaaacacaattaaagagaggaaaaagaatcaataaccctataaataaaaaatcagacaaacagaagtttcctcttcttcttccttaagctagtaccttttgttcttgaaattagggttaatttcttttttccaaataccatcaattctccagaccataaaaactcaaaaagatcagatctttcctctgaaaaagagatacccaacttatgtttttgtgtgtctgtatatagataaacattacatacccatatttgtgtatagacataaaaagtggaaattaaggtaacaaaaagaaatgggaagaggaagagtagagctgaagaggatagagaacaaaatcaacagacaagtaacgtttgcaaagcg

SEQ ID NO: 235 - DNA, 405 bp, Arabidopsis thaliana
aacttccccacttccaaccaaaattaatttaaaatgtcaaatattttttcattttcctcttttcgaaattaaagaaaaccctaaacgccgttgtctgatattgagagagagagagagagattaaaaacttcttctggttccttttatcaacattttttctctctcttaaaacttcgaagcgatttttgatttacagactatggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttggagtggttgaagaagaggatttggaatggatttcaaacaaaaatgc

SEQ ID NO: 236 - DNA, 418 bp, Arabidopsis thaliana
tacagactatggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttggagtggttgaagaagaggatttggaatggatttcaaacaaaaatgcttttccggtgattgaaacattcgtcggtgtattaccgtcggagcattttcctataacgtctcttctggaaagagaagcgactgaggtaaaacagctgagtccggtttcagtacttgagacgagtagccatagctccacaacgactacctcaaacagtagcggcggaagtaacggaagcacggccgtggctacgaacaaacacac

SEQ ID NO: 237 - DNA, 351 bp, Arabidopsis thaliana
ctttcatctgagacagagaggtgcattttgcagatgggtatgagacgaagcagagccgaagggaagaggcgcttacgataactgagtgaggaacacgaagaagaatacgacactgaccatgaacagacgtttgacgaagaagaggctttggaaaagaatcatacaggtaaagctacaagtagtattggagtttgtcatgtctagatttgtaccgccgctctgagcaaagccaaacagtaccacaaacgacacatagtctgccaatttcatgccaaagctcctcatgttcggatctctggtcatcaccatcgtatctgccatgactgcagcaggtttcacgcgctcagtgac

SEQ ID NO: 238 - DNA, 388 bp, Arabidopsis thaliana
cccacgcgtccgcccacgcgtccgctttcatgtgagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagcca

SEQ ID NO: 239 - DNA, 405 bp, Arabidopsis thaliana
ctttcatgtgagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagaga

SEQ ID NO: 240 - DNA, 419 bp, Arabidopsis thaliana
atttcatgtgagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcac

SEQ ID NO: 241 - DNA, 460 bp, Arabidopsis thaliana
  unsure (1)..(460): unsure at all n locations
catatcttcttcttatacccttcgaccaacgaagaaccctagaaatcgattaacaagatgaatagggaaaagttgatgaagatggctaacactgtccgcactggcggtaaggggacagtaagaagaaagaagaaggctgttcacaagaccactacaaccgatgacaagaggctccagagcactcttaagagagttggagtcaattccattcccgccattgaagaagttaacatttttaaggatgatgtagtcattcagttcattaaccctaaagttcaagcttcaattgctgctaacacatgggttgtgagtggtacaccacagacganaaaattgcaagacattcttcctcagattatcagccaacttggaccagataacttggacaacctgaagaagctagcagagcaattccagaaacaagctccaggtgcangtgatgtcncagcaacaatccaag

SEQ ID NO: 242 - DNA, 432 bp, Arabidopsis thaliana
tacggctgcgagaagacgacagaaggggctctctcctctgttctctcttcccttatcttcttcttatactcttcgaccaacgaagaaccctagaaatcgattaacaagatgaatagggaaaagttgatgaagatggccaacactgtccgcactggcggaaaggggacagtaagaagaaagaagaaggctgttcacaagaccactacaaccgatgacaagaggctccagagcactcttaagagagttggagtcaattccattcgcgccattgaagaagttaacatttttaaggatgatgtactcattcagttcattaaccctaaagttcaagcttcaattgctgctaacacatgggttgtgagtggtacaccacagacgataagattgcaagacattcttcctcagattatcggccaacttggaccagataac

SEQ ID NO: 243 - DNA, 433 bp, Arabidopsis thaliana
acagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgata

SEQ ID NO: 244 - DNA, 436 bp, Arabidopsis thaliana
  unsure (1)..(436): unsure at all n locations
gaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccangaaaattagcaagaaact

SEQ ID NO: 245 - DNA, 403 bp, Arabidopsis thaliana
caaaaaaaccagatcttaaaactctctctacccaccaagaggatcaaccagtctcttccccttcagattctcctttccacagtgaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaatatcatgaaagcggatgacgatttccgtatgatctcggctgaggcgcctgtcgtg

SEQ ID NO: 246 - DNA, 447 bp, Arabidopsis thaliana
ttaaaaaccacaggcgagagaaagatattcactctccccttatataagcacggaattataaatctttttccctcttcgattctcacttctttgtataaaaggcttctccttttctcaattcttcggcttcctttcgcccaaactcttccctcgaatctttccttctcgtcttaaagctacaataccctacatgtcggatatcttcgcaatgcacataagattgactgatcaatgattggaatggagtaaacaagttgatcttagcaagcatccttcagggattgttcgtactcttcaaaatattgtctccatagtgaacttagactgcaagctagatcgtacagccatagctatgcatgctcggaatggtgaatattatcacaagcgttttgctgcagtgataatgaagatcagataaccgaatactacagcattaatattcgcctc

SEQ ID NO: 247 - DNA, 197 bp, Arabidopsis thaliana
gttcctactcttcaaaatattgtctcaacagtgaacttagactgcaagcttgatcttaaagccatagctttgcaagctaggaatgctgaatataaccccaagcgtttcgctgctgtaatcatgaggatcagagagccaaagaccacagcgttaatttttgcttctgggaaaatggtgtgtaccggagctaaaagtga

SEQ ID NO: 248 - DNA, 347 bp, Arabidopsis thaliana
atcgagctacttcctccgccggctttgctgtgtgtgtgatcgttcgtttactaaatctgaaacaagtatctaacgccttgccggagatgtcgagctcaggccaaactcagttccgttatacacagacgccgtcgaaggtggttcatctgcggaatcttccatgggaatgcgtcgaagaggagctcatcgacctttgcaaacgattcggcaagatcgtcaataccaagagcaatgtcggcgccaatcgcaatcaagctttcgtcgaatttgctgacttgaatcaagctatatcaatggtttcgtattaagcgtcatcttcagagcccgcacagattcgtgggaaaact

SEQ ID NO: 249 - DNA, 386 bp, Arabidopsis thaliana
gctacttcctccgccggctttgctgtgtgtgtgatcgttcgtttacgaaatctgaaacaagtatctaacgccttgccggagatgtcgagctcaggccaaactcagttccgttatacacagacgccgtcgaaggtggttcatctgcggaatcttccatgggaatgcgtcgaataggagctcatctacctttgcaaacgattcggcaagatcgtcaataccaagagcaatgtcggcgccaatcgcaatcaagctttcgtcgaatttgctgacttgaatcaagctatatcaatggtttcgtattatgcttcatcttcatagcccgcacagattcgtgggaaaactgtctatattcagtactctaatcgccatgagattgttaacagtca

SEQ ID NO: 250 - DNA, 334 bp, Arabidopsis thaliana
atcgagctacttcctccgccggctttgctgtgtgtgtgatcgttcgtttactaaatctgaaacaagtatctaacgccttgccggagatgtcgagctcaggccaaactcagttccgttatacacagacgccgtcgaaggtggttcatctgcggaatcttccatgggaatgcgtcgaagaggagctcatcgacctttgcaaacgattcggcaagatcgtcaataccaagagcaatgtcggcgccaatcgcaatcaagctttcgtcgaatttgctgacttgaatcaagctatatcaatggtttcgtagtatgcttcatcttcagagcccgcacaaat

SEQ ID NO: 251 - DNA, 416 bp, Arabidopsis thaliana
gctctccctctcctctccctttgagaaatccctaactctttgctcttctcttcccggcgatctatctctccgatttgggtattgaaatggcaactcctatggttgaagatacgtcaagcttcgaagaggatcagcttgcttccatgtccaccgaagatatcactagagctactcgtcttctcgacaacgagattcgaattctcaaggaagacgcgcaaagaacaaatctagaatgtgattcttacaaggagaagattaaggagaatcaggagaagattaaactcaacaagcagctgccttacttggttggcaacattgtcgagattttggagatgaatccagaagatgatgctgaggaagatggtgcaaatattgatcttgactcgcaacggaaaggaaaatgtgttgtgttgaaa

SEQ ID NO: 252 - DNA, 441 bp, Arabidopsis thaliana
accacgcgtccggtcgctctccctctcctctccctttgagaaatccctaactctttgctcttctcttcccggcgatctatctctccgatttgggtattgaaatggcaactcctatggttgaagatacgtcaagcttcgaagaggatcagcttgcttccatgtccaccgaagatatcactagagctactcgtcttctcgacaacgagattcgaattctcaaggaagacgcgcaaagaacaaatctagaatgtgattcttacaaggagaagattaaggagaatcaggagaagattaaactcaacaagcagctgccttacttggttggcaacattgtcgagattttggagatgaatccagaagatgatgctgaggaagatggtgcaaatattgatcttgactcgcaacggaaaggaaaatgtgttgtgttgaaaacgtctacac

SEQ ID NO: 253 - DNA, 371 bp, Arabidopsis thaliana
ccattgataaatccctaactctttgctcttctcttcccggcgatctatctctccgattgggtattgaaatggcaactcctatggttgaagatacgtcaagcttcgaagaggatcagcttgcttccatgtccaccgaagatatcactacagctactcgtcttctcgacaacgagattcgaattctcaacgaagacgcgcaaagaacaaatctagaatgtgattcgtacaaggagaagattaaggagaatcaggagaagattatactcaacaagcagctgccttacttggatggcaacattgtcgagattttggagatgagtccagaagatgatgccgaggaaaatggtgcaaataatgatcttgactcgcaa

SEQ ID NO: 254 - DNA, 410 bp, Arabidopsis thaliana
accctaactctttgctcttctcttcccggcgatctatctctccgatttgggtattgaaatggcaactcctatggttgaagatacgtcaagcttcgaagaggatcagcttgcttccatgtccaccgaagatatcactagagctactcgtcttctcgacaacgagattcgaattctcaaggaagacgcgcaaagaacaaatctagaatgtgattcttacaaggagaagattaaggagaatcaggagaagattaaactcaacaagcagctgccttacttggttggcaacattgtcgagattttggagatgaatccagaagatgatgctgaggaagatggtgcaaatattgatcttgactcgcaacggaaaggaaaatgtgttgtgttgaaaacgtctacacggcagaccatct

SEQ ID NO: 255 - DNA, 410 bp, Arabidopsis thaliana
ctcctctccctttgagaaatccctaactctttgctcttctcttcccggcgatctatctctccgatttgggtattgaaatggcaactcctatggttgaagatacgtcaagcttcgaagaggatcagcttgcttccatgtccaccgaagatatcactagagctactcgtcttctcgacaacgagattcgaattctcaaggaagacgcgcaaagaacaaatctagaatgtgattcttacaaggagaagattaaggagaatcaggagaagattaaactcaacaagcagctgccttacttggttggcaacattgtcgagattttggagatgaatccagaagatgatgctgaggaagatggtgcaaatattgatcttgactcgcaacggaaaggaaaatgtgttgtgttgaaaacg

SEQ ID NO: 256 - DNA, 392 bp, Arabidopsis thaliana
gaaatccctaactcattgctcttctcttcccggcgatctatctctccgatttgggtattgaaatggcaactcctatggttgaagatacgtcaagcttcgaagaggatcagcttgcttccatgtccaccgaagatatcactagagctactcgtcttctcgacaacgagattcgaattctcaaggaagacgcgcaaagaacaaatctagaatgtgattcttacaaggagaagattaaggagaatcaggagaagattaaactcaacaagcagctgccttacttggttggcaacattgtcgagattttggagatgaatccagaagatgatgctgaggaagatggtgcaaatattgatcttgactcgcaacggaaaggaaaatgtgttgtgttgaaa

SEQ ID NO: 257 - DNA, 243 bp, Arabidopsis thaliana
tccaagcgtcagtacggctgcgagaggactacagaaagggcttaggagcagatttctattaatgaacaaaggtgcttggactaaaggaagaagatgagagactagtctcttacatcaagtctcaaggtgaaagtcgttggcgacctcttcgtagatccgctggtctcattcttatgctgtcatagctgccgtcttcggtggcttaaatatcgccgacctgatttcattcagaggaagtttatt

SEQ ID NO: 258 - DNA, 404 bp, Arabidopsis thaliana
  unsure (1)..(404): unsure at all n locations
atagaagccacttcctcctgctcaagccgtgagagaggcaaggagtgatgctccacgtggtggtggaggccgtggaggatttaaccgtggtcgtggtggttacaaccgtgatgatggtaacaatggatattcagggggatacactaaaccctcaggtgaaggagatgtttcaaagtcttcttacgagaggcgtggcggtggtggtgctcctcgtggttccttccgtggtgaaggtggtggacctggtggtggtcgtcgtggtggattcagcaatganggtggtgatggggaacgtcctcgaagggcctttgagcgtcgtagtggaactggcagagggagtgacttcaagcgtgacggatctggtcgtgggaattggggaactccagnggaagagatagctgctg

SEQ ID NO: 259 - DNA, 337 bp, Arabidopsis thaliana
cagacgcgtgggcgtggtggaaacaatagggattcaaggaacagtgatggtcctgccaatgaaaacggatatggtggaggctacagacgctcataagaaggagatggagctagacgtggtgggcctgttggtggataccgtggtgatcgccgtggaagctacagcaatggtggtgattcaggtgactctgaaagaccacgcaagaactatgaccgtcacagtagaacagcgtacgggaatgacgataaacgtgatggagctggccgtgcgaattggggaaccactcaggatgatattactccggtgactgaagaatccacagctgttgtggacaaga

SEQ ID NO: 260 - DNA, 430 bp, Arabidopsis thaliana
acggacgcgtgggatttttcttcatggattcgtatagccaataagttttttcaatattcaaaacaaaaaccccatcaaaataatctccggaccagtttctctttcgattcagtcggaccggaaaaacaatggcgtctgtgaaccctttcgatctcttggacgatgacgcagaggatcccagccagattgttgcgtctaagccattgaaggttgtggctccggttcagactgctaagtctggtaagatgccgactaagccgcctcctccttctcaagctgtgagggaggcaaggaacgctcctggtggaggtcgtggtgctggacgtggagggagttatggtcgtggtggacgtggtggaaacaatagggattcaaggaacaatgatggtcctgccaatgaaaacggatatggtggaggctacagacgctc

SEQ ID NO: 261 - DNA, 436 bp, Arabidopsis thaliana
aacaaacgctgtctgaatcatatttcgattctgatttttcttcatggattcgtatagccaataagttttttcaatattcaaaacaaaaaccccatcaaaataatctccggaccagtttctctttcgattcagtcggaccggaaaaacaatggcgtctgtgaaccctttcgatctcttggacgatgacgcagaggatcccagccagattgttgcgtctaagccattgaaggttgtggctccggttcagactgctaagtctggtaagatgccgactaagccgcctcctccttctcaagctgtgagggaggcaatgaacgctcctggtggaggtcgtggtgctggacgtggagggagttatggtcgtggtggacgtggtggaaacaatagggattcaaggaacaatgatggtcctgccaatgaaaacggatatggtgga

SEQ ID NO: 262 - DNA, 383 bp, Arabidopsis thaliana
aacaaacgctgtctgaatcatatttcgattctgatttttcttcatggattcgtatagccaataagttttttcaatattcaaaacaaaaaccccatcaaaataatctccggaccagtttctctttcgattcagtcggaccggaaaaacaatggcgtctgtgaaccctttcgatctcttggacgatgacgcagaggatcccagccagattgttgcgtctaagccattgaaggttgtggctccggttcagactgctaagtctggtaagatgccgactaagccgcctcctccttctcaagctgtgagggaggcaaggaacgctcctggtggaagtcgtggtgctggacgttgagggagttatgggcgtggtggacgttgtggaaaca

SEQ ID NO: 263 - DNA, 377 bp, Arabidopsis thaliana
gaaaaacaccatcatagttcttaaaaatcgtcttaccaactcaacaacataaaatcccagatggatccaatagaaacggagaacataaatcagaaaaccaaaatctttgcctagatataagagactttgcgatgacgagagcatcattactgactagcgccaagccacttggtgaagttatcgaactcggtgtagtcactgtctgaaatcatagtctgataccaagccttgcctgctgctttgatcgcttgggcctcctccttagtgacgactttcctcttcttctcgagcctctccttcttagccttaacccttgaagcttcagccaacagagacattctctttgcggtcttagcataaggattcaacttgaacat

SEQ ID NO: 264 - DNA, 412 bp, Arabidopsis thaliana
aaagaatcatgggacaaggaccatcgggaggattgaatcggcaaggagatcggaaacctgatggtggagataagaaagagaagaagtttgagccggcggcaccaccggctcgtgtagggaggaagcaaacgaagcacaaagggccagaggcggcggcgagacttccgacggtgactccgtctactaagtgtaagctccggttactgaaattggcacggatcaaggattatttgttgatcgaggaagagtttgtggcgaatcaagagaggttgaaacctcacgaagagaaagctgacgaagatagatctaaggttgatgatcttcgtggtacacctatgagtgttgggaatttggaagagttgactgatgagaatcacgctattgtttcatcgtctgttggacctgagtacta

SEQ ID NO: 265 - DNA, 412 bp, Arabidopsis thaliana
gagaggttgaaacctcaggaagagaaagctgaggaagatagatctaaggttgatgatcttcgtggtacacctatgagtgttgggaatttggaagagttgattgatgagaatcacgctattgtttcttcttctgttggacctgagtactacgttgggattttgtccttcgttgataaagatcagcttgaacctggatgttcgattttgatgcataataaggttctctctgttgttgggattctacaagatgaagtggatccaatggtgtctgtgatgaaagttgagaaagctcctttggagtcatatgctgatattggaggtttagaagctcagattcaggagattaaggaagctgttgagcttcctttgactcatcctgagttgtatgaagatattggtattaaaccaccaa

SEQ ID NO: 266 - DNA, 332 bp, Arabidopsis thaliana
gagacaaggaccatcgggaggattgaatcggcaaggagatcggaaacctgatggtggagataagaaagagaagaagtttgagccggcggcaccaccggctcgtgtagggaggaagcaaaggaagcagaaatggccataggcggcggcgagacttccgacggtgactccgtctactaagtgtaagctccggttactgaaattggaacggatcaaggattatttgttgatggaagaagagtttgtggcgaatcatcagaagttgaaacctcatgaacacaaagctgacgaatatagatctaacgttgatgatcttcgtggtacacctatgagtg

SEQ ID NO: 267 - DNA, 404 bp, Arabidopsis thaliana
gagaagagagaagaatcatgggacaaggaccatcgggaggattgaatcggcaaggagatcggaaacctgatggtggagataagaaagagaagaagtttgagccggcggcaccaccggctcgtgtagggaggaagcaaaggaagcagaaagggccagaggcggcggcgagacttccgacggtgactccgtctactaagtgtaagctccggttactgaaattggaacggatcaaggattatttgttgatggaggaagagtttgtggcgaatcaagagaggttgaaacctcaggaagagaaagctgaggaagatagatctaaggttgatgatcttcgtggtacacctatgagtgttgggaatttggaagagttgattgattgagaatcacgctaatggttcctcctc

SEQ ID NO: 268 - DNA, 407 bp, Arabidopsis thaliana
cggacgcgtgggcggacgcgtgggagagagaagaatcatgggacaaggaccatcgggaggattgaatcggcaaggagatcggaaacctgatggtggagataagaaagagaagaagtttgagccggcggcaccaccggctcgtgtagggaggaagcaaaggaagcagaaagggccagaggcggcggcgagacttccgacggtgactccgtctactaagtgtaagctccggttactgaaattggaacggatcaaggattatttgttgatggaggaagagtttgtggcgaatcaagagaggttgaaacctcaggaagagaaagctgaggaagatagatctaaggttgatgatcttcgtggtacacctatgagtgttgggaatttgggagagttgattgatgagaatcacg

SEQ ID NO: 269 - DNA, 434 bp, Arabidopsis thaliana
agagacgaagcacaatgggtcaaggaccttccggcggattgaatcggcaaggagatcggaaaccagatggtggagagaagaaggagaagaagttcgaaccagccgcaccacctgctcgtgtagggaggaagcaacggaagcagaaaggacctgaagcggcggcgagattgccgacggtgactccttctactaaatgtaagcttcgattgctgaaattggagcgaatcaaggactatttgcttatggaggaagagttcgtagcgaatcaggagagattgaaacctcaggaagagaaagctgaggaagatagatctaaagttgatgatcttcgtggtacacctatgagtgttggcaatcttgaagagcttattgatgagaatcacgccattgtttcttcttcggttggtcctgagtactacgttggcattttgtct

SEQ ID NO: 270 - DNA, 422 bp, Arabidopsis thaliana
gatgcaagtggagcataagctattctattttgatcttaaggagaatcctcgtggaaggtatctaaagatatcggagaagacgtcggcgacgaggtcaaccatcattgttccttcctccggcatctcttggttccttgatctcttcaactactatgtcaattctgaggaacacgagctttttagcaaagaattgcagcttgattccaaggtgttttacttcgatatcggtgagaacagaagaggacgcttcttgaaggtgtcagaagcatcggttagtagaaatcgaagtaccattattgttccagctggaagctctcctgatgaaggatgggcagctttcaggaatatattggctgagatacatgaagcatcaggactttttgtgatgccaaatcagaaaccttctgatggacaggaacact

SEQ ID NO: 271 - DNA, 407 bp, Arabidopsis thaliana
ctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggtta

SEQ ID NO: 272 - DNA, 401 bp, Arabidopsis thaliana
accaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaagaaatgcggcggttacgaacatcggggtta

SEQ ID NO: 273 - DNA, 365 bp, Arabidopsis thaliana
aaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaag

SEQ ID NO: 274 - DNA, 397 bp, Arabidopsis thaliana
cccacgcgtccgcccacgcgtccgctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgct

SEQ ID NO: 275 - DNA, 384 bp, Arabidopsis thaliana
aatcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgacgaagacgagacgatcgcacgtgctcacgctcagttcggtaataaatgggcgacgattgctcgtcttctcaacggtcgtacggacaacgccgtgaagaatcactggaactcgacgctcaagaggaaatg

SEQ ID NO: 276 - DNA, 422 bp, Arabidopsis thaliana
cagacgcgtgggctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacga

SEQ ID NO: 277 - DNA, 387 bp, Arabidopsis thaliana
accacacgtccgctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaag

SEQ ID NO: 278 - DNA, 390 bp, Arabidopsis thaliana
agggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgat

SEQ ID NO: 279 - DNA, 252 bp, Arabidopsis thaliana
cccacgcgtccgcggacgcgtgggcggacgcgtgggctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccag

SEQ ID NO: 280 - DNA, 388 bp, Arabidopsis thaliana
atcgtcgtcatttctctctctaaccccttctctcttcagtctctctctctctagacgatctctatcttgaataaaataccgataatgacctcaaccaatccggtggtcgccgaagtaataccggcggaaacttctacagatgctacagagacgacgattgcaacgacggaagctggtgaagcaccggagaagaaggtgaggaaagcttacacaatcaccaagtctagagagagttggactgaaggagaacacgacaagtttctggaagctcttcaattgtttgatcgtgactggaaaaagatagaagattttgttggttcaaagacagttattcagatcaggagccatgctcaaaaatactttctaaaagtccaaaacaatgggaatt

SEQ ID NO: 281 - DNA, 403 bp, Arabidopsis thaliana
accacgcgtccgctctctctaaccccttctctcttcagtctctctctctctagacgatctctatcttgaataaaataccgataatgacctcaaccaatccggtggtcgccgaagtaataccggcggaaacttctacagatgctacagagacgacgattgcaacgacggaagctggtgaagcaccggagaagaacgtgaggaaagcttacacaatcaccaagtctagagagagttggactgaaggagaacacgacaagtttctggaagctcttcaattgtttgatcgtgactggaaaaagatgaaagattttgttggttcaaagacagttattcagatcaggagccatgcgcagcaatactttctaaaggtccaaaaaatgggaccttagcacatgttcaaccc

SEQ ID NO: 282 - DNA, 355 bp, Arabidopsis thaliana
acttaaagaaatgcttgagtttcacaaatctcacggtggggaagcctccataatggtaacaaaggtggatgaaccgtcgaaatatggagtggttgttatggaagaaagcactggaagagtggagaagtttgtggaaaagccaaaactgtatgtaggtaacaagatcaacgctgggatttatcttctgaacccatctgttcttgataagattgagctaagaccgacttcaatcgaaaaagagactttccctaacattgcagcagcgcaagggctctatgctatggtgctaccagggttttggatggacattgggcaaccccgtgactacataacgggtttgagactctacttagac

SEQ ID NO: 283 - DNA, 286 bp, Arabidopsis thaliana
ctttcttttgaggatcagatcgtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaaacctcattttgagc

SEQ ID NO: 284 - DNA, 427 bp, Arabidopsis thaliana
ttcttcttctacttcgtcctcatcatcgtcacatagatcctcctttttcgttaattggggagagatatactttcttttgaggatcagatcgtgacagggtttagctcaaggagaggtattagatccgtactttgtgataaactttctcaagggtgagaaaaagaagaagaaggtgagacatgtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggcaggtgtattgtcctgtaagcctcattttgagcagctctttaatgagagtggcagtttcaacaacaact

SEQ ID NO: 285 - DNA, 359 bp, Arabidopsis thaliana
gagagatatactttcttttgaggatcagatcgtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcaccctgcaaaatcggctgac

SEQ ID NO: 286 - DNA, 362 bp, Arabidopsis thaliana
cccacgcgtccgtcttcgtcttctacttcgtcctcatcatcgtcacatagatcctcctttttcgttaattggggagagatatactttcttttgaggatcagatcgtgacagggtttagctcaaggagagggtgagaaacagaagaagaaggtgagaaaagtgaacgcaaggctttgaggatgtcttttacaggaactcaacataaatgcaaggcttgtgagaagactgtttatgctgttgagcttctctctgctgatggagttggatatcagaagtcttgcttcaaatgcactcactgcataagcaggcttcagctgagtagttactcatcaatggaaggtgttttgtactgtaagcctcat

SEQ ID NO: 287 - DNA, 383 bp, Arabidopsis thaliana
aactttttcgttaattggggagagatatactttcttttgaggatcagatcgtgacagggtttacctcaaggagagggtgacaacacgaagaagaaggttagaaaagttaaggcaaggctttgaggatgtcttttacaggaactcaacagaaatgcaaggcttgtgagaagactgtttatgctgttgagcttcactctgctgatggacttggatagcacaagtcttgcttcaaatgcactcactgcaaaagcaggcttcagctgagtagttacacatcaatggaaggtgttttgtactgtaagccacaatttgatcagctctttaatgacagtggtaatgtcaataagaactttcattcacctgcaaaatctgctgataaatca

SEQ ID NO: 288 - DNA, 385 bp, Arabidopsis thaliana
cttcttcttctacttcgtcctcatcatcgtcacatagatcctcctttttcgttaattggggagagatatactttcttttgaggatcagatcgtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtgggagtttcaac

SEQ ID NO: 289 - DNA, 460 bp, Arabidopsis thaliana
agcgaaaactaatctctctcctttttcttctcatctccttactaaagatctctgtcttcgataatttgtttcaatcactgagaaaatggaggccgtatgactagattctaggcgtcatgacacagcgatggaggaaacctgtaacgtgaaaggagcggcggagaaacaatgggaaaggcttaagcagtactatctccagcacatccatgagctccagcgccagcttcgacataagactaataacctcaatcgccttgaagctcaaaggaatgaactcaattctcgagtgagaatgctcagacaagacttacagctccttcaagaacctgagtcctatgtgggagaagtggtaaaagttatgggaaagaacaaggtcatggttaaggttcatccagaggggaagtatgttgttgatattgacaaaagtatagacattacgacaatcactccatcaacgaga

SEQ ID NO: 290 - DNA, 456 bp, Arabidopsis thaliana
  unsure (1)..(456): unsure at all n locations
acgaaaaataatctctctcctttttcttctcatctccttactagagatctctgtcttcgataatttgtttcaatcactgagaaaatggcggccgtaggagtagattcgaggcgtcctgagacagcgatggaggaaacctgtaacgtgaaaggagcggcggcgaaacaaggggaagggcttaagcagtactatctccagcacatccatgagctccagcgccagcttcgacagaagactaataacctcaatcgccttgaagctcaaaggaatgaactcaattctcgagtgagaatgctcagagaagagttacagctccttcaagaacctgggtcctatgtgggagaagtggtaaaagttatgggaaagaacaaggtcttggttaaggttcatccagangggaagtatgttgttgatattgacaaaagtatagacattacgaaaatcactccatcaacg

SEQ ID NO: 291 - DNA, 395 bp, Arabidopsis thaliana
cagaaagtcgagaaagctgctgctgctgttcagcctcctaaggccgctaagttcccaaccaagccggctcctccttctcaagcagtgagggagtcgaggaatgctcctcaaggaggtcgtggtgggactggtggacgtggtggattttcccgtggcaggggtaatggtggatacaaccgggacaacaggaacaatgatgctcctggaaatgagaatggattttctggaggatacaggagaccttctgaagatgctgatggagcaagccgtggtgggtctgttggtggataccgtgttggcggtggtcgtgaaggacctcgccgtggtggagttgccaacggggaatctggtgatgttgaacgcccaccgaggaattatgaccgccataacaggac

SEQ ID NO: 292 - DNA, 420 bp, Arabidopsis thaliana
ggggaatctggtgatgttgaacgcccaccgaggaattatgaccgccatagcaggacaggtcatggtactggcatgaaacgtaatggtggaggtcgtggaaactggggcactactgaagatgatatccctccaacgtctgaggaacctaccacagaggttgagaagagccctgttgctgagaagcaaggaggtgaggatgaaacccctgaagcaaagaaagaactcactgcggaagagaaagcacagaaagaagctgaagaagctgaagccagggagatgactctagaagagtatgagaaaattctggaggagaagaagaaggctctgcaagccacaaaggttgaggaaaggaaagttgacaccaaagtgtttgagtccatgcaacagctctctaacaagaagaacaccgatgaagaaatc

SEQ ID NO: 293 - DNA, 445 bp, Arabidopsis thaliana
gttacgctatctcttaaacacaaacagctctgtccgaataatctctcttcaagtacctcttttttctgattctgtatatcgccatgaattactgatttccctctctataaacccatcaaagtaaaccaatttctcctgtgacttgtacctaactcgatcttaccagactggtgatggcgtctttgaaccctttcgatcttctaggagatgatgctgaggatccaagccagctcgctgtggctttgtctcagaaagtcgagaaagctgctgctgctgttcagcctcctaaggccgctaagttcccaaccaagccggctcctccttctcaagcagtgagggagtcgaggaatgctcctcaaggaggtcgtggtgggactggtggacgtggtggattttcccgtggcaggggtaatggtggatacaaccgggacaacaggaacaatga

SEQ ID NO: 294 - DNA, 445 bp, Arabidopsis thaliana
aaaaaaagaaaaaacaaaatgagagagagagagagagagagagagagagaaacgaagaaaaataaagaagcacaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaaatatctgccactcaaagagttacaagaaatagtccaaag

SEQ ID NO: 295 - DNA, 429 bp, Arabidopsis thaliana
cacatatcggagatttgaagccatgggaagaagaaaaatcgagatcaagcgaatcgagaacaaaagcagtcgacaagtcactttctccaaacgacgcaatggtctcatcgacaaagcgcgagaggtttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagtaagtaattagctaagaacgtcattctaatattcttctggatgcggtttttggtgttatgaaggatagaagcgctgttcaagccggagaaacctcaatgttttgaactcgatcttgaagaaaaaattcagaattatcttccacacaaggagttactagaaaca

SEQ ID NO: 296 - DNA, 366 bp, Arabidopsis thaliana
tacggctgcgagaagacgacagaagggggaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataa

SEQ ID NO: 297 - DNA, 442 bp, Arabidopsis thaliana
tacagctgcgagaagacgacagaaggggagagagagagagagagaaacgaagaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaagctcggaattatctgccactcaaagagttactagaaatagtccaaagcaag

SEQ ID NO: 298 - DNA, 423 bp, Arabidopsis thaliana
cccacgcgtccgcccacgcgtccgtacggctgcgagaagacgacagaagggggaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggagga

SEQ ID NO: 299 - DNA, 456 bp, Arabidopsis thaliana
ccaacgcgtccggttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgt

SEQ ID NO: 300 - DNA, 231 bp, Zea mays
gcacgaggttgagcgtcttccttcaaaagtgtataggaaaccattgaaataccagagcgaggaagcagcacaatgctatatttgccttgttgaatatgaagagggagattgcctccgtatacttccatgccatcatgaattccatctaacatgtgtagacaaatggctaaaggagattcacagggtttgcccactttgtcgtggcgatgtttgcagatctgatgcacccat

SEQ ID NO: 301 - DNA, 329 bp, Zea mays
ctccttgttcatcttcatgaacgtcgtcctgagaagctccattatcttggtgtatcttttggactgacccaagagcttttccgcttttggcggaagcacaacttctacccgttctatgtcggccagattccaagtgctgttactggtgagcatacctgtatggtgttgagacccttaaacagtgatgacatcgaagttagtgagtcaaacaaacatggattttgtggatccgttttaccaagatttcagacaaagattcaggcggcttttgggaacttctttccggcatcttaattttaagcttgcaatgagtgtcttggcttcgaaga

SEQ ID NO: 302 - DNA, 290 bp, Zea mays
cggctcgagtcgcgctctgcctcctcatgctctcccgcggtggccaccaccgcgtccaggcgttcgcaacgccggtcccgtccgccgcggagttcaggtgctccgtctgcggcaagtccttcagctcctaccaggcgctgggggggcacaagaccagccaccgggtcaagctgccaacccctcctcctcctgctgctgccgccgccgctgtaactgtcccggcagcagtgcccgtcccggaggcccccgccccgatcaccgtcgtcgtcgcgccgctgccagcagtcgag

SEQ ID NO: 303 - DNA, 269 bp, Zea mays
cttaaacctttgttatcttctggggaagagttattttgttgagctcctgttttttgctacttgagtcaatacggagtactgtcaggcctgtgccaaggggtgtgcgagctgttcactcgtacagggtcccgcaaaatctagggccccaaatatgagtgctgtatctgcctatgcccgtatgaagatggcgtggaactacgtgagctcccttgcaaccaccattttcactgcagctgtatagacaagtggcttcacataaatgctacatg

SEQ ID NO: 304 - DNA, 265 bp, Zea mays
tattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgt

SEQ ID NO: 305 - DNA, 329 bp, Zea mays
  unsure (1)..(329): unsure at all n locations
cggctcgaggcaagganggcgcacttagtgcgcgccgcatctgcttcttcgcccacgatgaagatgagctccgccatgtgcctcacaatagtggtgcaggtctgctgtctcgccgtgcctcttcatccattgacatgaccgctgctgctgctgctctagggcttctacctggatctcctaccaggcactttgtgccaccacctctgtcaccatctgctgccaacaatggtggaggtgctgctgctcattggctccaaggtagcaggctgcgctcttctttcaatgcaagagatgcacatgctgatgaccttggctcgctcctggaatgg

SEQ ID NO: 306 - DNA, 256 bp, Zea mays
ggcgtcggcagcgcgccgcgtccaccgacgtcccggcggcgcccgccgagacgtccgccgaggtcgggagctccgccgcgcgtgcgttcgacctcaacctcccggccgtgccgtagttcgtgttccggtgcggcaagcccggcaagatgtgggaggacgacgaggaggtgcagagccccctcgccttcaagaagccccgcctcctcatgaccgcgtgaaaccgctgcgcgcgcgggcggcggatctcatctcatca

SEQ ID NO: 307 - DNA, 305 bp, Zea mays
ctcaacagcgctacaagtgcagtccatgcatcgatccatggcagcagacatcaagtgcgagcagccgaagcggacgccgagcccgagcgcttcgtctctgaggatcttcggctacgacgtggctggctcgggtatcgccgaccgcatcatcgagcctccgcctcaggacgatggccggccggccgtggtggacagcaggcgcaggttcgagtgccagtactgctgccgcgagttcgctaactcgcaggcgcttggcggacaccagaacgcgcacaagaaggagcggcagcagctgaagagggagc

SEQ ID NO: 308 - DNA, 290 bp, Zea mays
tgaaattcaccgtcaacctgcatcactttcactttccatggtctctgttcaggctcctgaatctgtagttgattcgttgccatgtaagagctacaaaaagcttgagacaccccaatgcagtgatgatatggaacagtgccatatctgcctaaccgaatatgaggacggagaccagataagaacccttccgtgcaagcacgagttccacctgcaatgcgttgacaagtggctgaaagaaatacacagggtgtgccctctgtgccgtggagacgtctgcgaagtcgcctcgt

SEQ ID NO: 309 - DNA, 298 bp, Zea mays
tgaagatgctgatatgcgattcttgtgaagcaggatttcatttgtcttgctgcattccttgtattaaggagctacctactgatgaatggtattgtgctccatgcttgtgtaagaaacccaagagtctttatggcaaactctcagagggcaggataaatccttccaggaatactaacacaaggcctcatgggatgagtcacatagagtacatgctgaaggatgctgaaccatatgtaactggggttcgacttggtagagattttcaggcagaggtgccagaatggtctggtccatcatc

SEQ ID NO: 310 - DNA, 267 bp, Zea mays
ctgcgttgacatactgtagattgacaattcctgtttatgaaagagtttatccaccttttcatccgatgattggattacaattctatacttgtggaaagcttgaatggttgcttgagttcacagaggatgcactaaaatctttaaccagagcagcagatatacttaaagtaacacatggcgtaaaatcccagttcatgaaagagctctttggcaagttagaggaagcaagagctgaagtttcgtttagactatcctccagacatggac

SEQ ID NO: 311 - DNA, 340 bp, Zea mays
ctctccgctccgacgcgcccgacccaccaccacatccctcatggctgccctcgccgacatcgactcctcggcacttccgacgtccgagtcatccaaaggcaagggcaagatggacgaggaggaggaggacgaggcggagggcgcggagaagatgtgcggcatctgctatctcgacggccggcgggccatccgcggcgagctcgactgctgcgcccatttcttttgctttgtctgcatcatggcttggggccgcgtcgagtcccgctgtcccttctgcagggcccgcttccacaccatccgcacgccgcacgtcgccggccggttccccgacgagcgaatc

SEQ ID NO: 312 - DNA, 302 bp, Zea mays
gcgggagggaactcgcacgcgaaggcaaatacgctttagatcccccattgcttctggctactaggccagcgcgcctcgattttcttttccgttttggtctaattcgtgaggaatttgggttttctcggtggagcttggttccgctccgccttggagtggatttcggtgacttctttgttcagattgtttcgctcttgcaggctgaactcatggctcgcgtctacgttgggaacctggatccgcgtgtcacggcgcgggagatcgaggacgagttccggatgtttggggttctgaggagtgta

SEQ ID NO: 313 - DNA, 272 bp, Zea mays
cccacgcgtccgcagcttctctcttgttcgctagctcgtctcgcccggccggacgtggttcctgccttggcatatgcatagccacctggcctgcagcggctgcaacgtctcgtccagtaccgccggggagccgccggcgtccgctgcccaagctgcgacgctttcacggccgccgccaacccatcagggccgccggagatgtctgagctggtgtgcggcggctgcttcaccatgctggtgcactcccgcagcgccgccaacgtgcgctgccc

SEQ ID NO: 314 - DNA, 242 bp, Zea mays
ctcttatccgaatgtgatcatcctttctgtattgaatgcattagaaattggcgtacaattctcctgcatctggtatggatgtgaactcagcattgagggcttgtccaatatgtcggaaactttcatactatgtcattccaagtgttctttggtacttctcaaaggaagagaaagaggagatcactgaaagctacaaatccaagctcaagtctattgattgcaagtacttcgactttgggact

SEQ ID NO: 315 - DNA, 244 bp, Zea mays
acaggaggcatgtcaagggatttgattgataggatcccaaagacgaggttcagtgctgcgagcaactgtgatcaggaaactgatagcagctgctgcccagtctgcctccaggatttcggagcacggcaattcgtgagggccctgcctcagtgccaacacatattccacgtgcggtgcatcgacagttggctcctccggcacgcgtcctgcccgctatgccgggcaggtgttcacatagaccata

SEQ ID NO: 316 - DNA, 222 bp, Zea mays
gaaacacaaactgatgaaaaattctgagatatgcattctgcattaggtccttcaacacacatctttgtgttctgtgctcaggtagttgctgctggagacttgtgtgcgatatgccaagaaaagatgcatgttcccatccttttgcgctgcaaacatatcttctgtgaagattgtgtatccgaatggttcgagagggagcgaacgtgcccgctgtgtagggca

SEQ ID NO: 317 - DNA, 248 bp, Zea mays
gattcttggcccaggaactaagacggacagacttgtttcagctgacgacgctgtgtgctgcatctctcttacgactatggagatgatgatgagcttcgtcaggctccttgcacacacttctttcatgttcaatgtgtagataaatggcttaacataaatgccgtgtgccgactctgtcaaacagagattggcggtgtggttcgacgtttctttggcttgccatttcgccgtcgcgtgtcgatacgata

SEQ ID NO: 318 - DNA, 240 bp, Zea mays
cggacgcgtgggtggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagtcgcagtcgcagtcgcagcaggagcagaagccgcagccgcagccgcagccctagata

SEQ ID NO: 319 - DNA, 223 bp, Zea mays
gttgtttcagctgaagatgcttccagctccatgtaccaacttgcgttttggtggaatccagtttatcacaaactgtgaatcagttcatgaattctggtgacagtgtgctgcatctgtcttacgaatatggagatgatgatgagcttcgtgagcttccttgcacacacttctttcatgttcaatgtgtagataaatggcttaagataaatgcggtgtgcccact

SEQ ID NO: 320 - DNA, 243 bp, Zea mays
tggagatctgtgtgcattctgtgaaagacagtgcatgaatccttatcaatctgatgaaaggggggtacatgtcaagctatgcaagaaaaacaatagagttcttgaggccatgagaagaagtgaagacatagaatgtggtgtgtgcttggaccgtgtgctttcaaaacctacggcagcagaaaggaggtttgggctgctatctgactgcgaccattccttctgtatctcatgcattaggaattg

SEQ ID NO: 321 - DNA, 269 bp, Zea mays
tgctactggcaaaggaaacatagcgcgcctgattaatcactcgtgtatgccaagctgctatgctaggatcgtgaccgtcagtggtgacaggagccagatcattcttattgcgaagagagacgtctctgccggagaagagctgacgtagttcctcagccctgccagtataactacctgtttgaccctgacgagtccgaagactgcaaggttccatgcctgtgcaaagctcctaactgccgtggatacatgaactagggtgctgctagaag

SEQ ID NO: 322 - DNA, 326 bp, Zea mays
aggctcgagcggctcgaggaccgtatgcggtcacattttctgccagccgtgcatcaaggctgccattaagagtcagaagaagtgccctacctgccggaggaagctcactccaagacagcaacaccgggtgtacctcccatcgccttagtagcccagtgcagagtcattttgctacaagttctgccgtgccgggggctgtatgttggaggcaactgggggggggggggggggagcatagaggtcctgtttggttcgttcatttagtgtcataatcagttaacagggtaatctattaccattgctttatgtttggttagactatactg

SEQ ID NO: 323 - DNA, 236 bp, Zea mays
atcgccatctacctcgccgcgctcgccgggacccgcaagttcgggctcggtcgggagaaggaccagcaccagcacaccaagtggtgcccgacgacgacgacaacccacgcgccatctgcgcacaggagcttcggttccggtgcgcggtctgcgggaaggccttcgccacctaccaggcgctcggcggccacaagtccagccaccgcaagccgacgacgccggagcggtacgccgcc

SEQ ID NO: 324 - DNA, 273 bp, Zea mays
ctccgccgcagctcgccaactacaactccttcgagggagtgctctactgcaggcctcacttcgaccagctgttcaagaggacagggagcttggacaagagcttcgaaggtatcatcgttttccccccttccctttgcagtacgaaatagatccagtggtgttcttgcgtgtctcctcacctacaaatggcttcaggaactccgaaggttgtcaagccagaaagaaacgttgggaatgaggtatatgcaacgccttaatattcatgtgtttatg

SEQ ID NO: 325 - DNA, 297 bp, Zea mays
acatcagagaaaatatattaatcatcattcgtatgagtggaaaatatattttctctgatttgtgccgcaaatccatccgctctctcaaattctagtatacagtacaccgacatacataacatgacaacatgacccgtcacccgtcgctgcgaataccggagcgtctccaagatggtgctgcaaaacgacattgacttactcaatccaccggcagagcttgagaagctaaagcacaagaagaagcggctagtccagtcccccaactccttcttcatggatgtcaagtgccagggctgt

SEQ ID NO: 326 - DNA, 274 bp, Zea mays
cccacgcgtccgcggacgcgtgggccagtaggctctttaagaaaattgaattgaacgaatctattagatatgcctcatggtacccctgttgagacctggcttaatgacctactttgtttggatcttgcaaactccattccaaatatcagcaggctacctcacccaaaagaatgtgatctgtattatgtcaaccgggacacacttttctcatatcacaaggagagcgagatatttttacagcggatgatggcactttatgttgcttcccactaca

SEQ ID NO: 327 - DNA, 290 bp, Zea mays
ccaaggtagcaggctgcgctcttctttcaatgcaagagatgcacaggctgatgaccttggctcgctcctggaatgggaatctcaataccttggagcgctcagcctcccacaaagcagccgatcccagccccgtctttctactggtctgactattcgtccaacagcagttgctccatcctacctcgaagagatgtatgcttcagacatggctatgtcgccaaggttcaccaatgaccaaggtcactcagtcttctcaccagcacacaaatcagctcttctaaacaagtttc

SEQ ID NO: 328 - DNA, 243 bp, Zea mays
gcatttgttgcatctagcgcagggttataccgtttctgccccacaccggactgcacatccatttaccaagtagctgctgcaggcgcacaaggcgacagaccctttgtctgtggggcttgctctgtggagacctgcaccaagtgccatatcgagtaccatcctttcatctcctgtgaggcatacaaagagtacaaggcagacccggacgcaactctgcttgaatggcgcaaagggaaggagaac

SEQ ID NO: 329 - DNA, 281 bp, Zea mays
cgggaggaggcccgcaccgatgcacgatctgccggagggggttcgccacgggccaggcgctcggcgggcacaagcgctgccactactgggacggcgcgtcggcgtccgtctccctgtccgcgtccggtacggggtcgtcgggcgtcacactgaggaattttgacctcaacctgatgcccgtggcggagaacgcagggatgaagaggtgggtcgaggaggaggaggtgcagagtccactgccgatcaagaagcgcaggatcttggattagctctcgcgctac

SEQ ID NO: 330 - DNA, 205 bp, Zea mays
ctcatggaccatatttatgtccaaaacatacaaggtgccacagctgtggatctggtgtgcctggtagtggacacagcacaaggtggtttttggggtacacatgctgtgatgcgtgtggacgattgtttgtgaaaggaaactactgtccaatctgcttgaaggtttatagagactctgaagtgatacctatggtttgctgcgatgt

SEQ ID NO: 331 - DNA, 258 bp, Zea mays
cttccgtcggacttcaaaccctagcggcgatggcgtccgctgcggcgggcacaccgaagcgctgctactacgaggtcctgggcctatctcgcgactgctccccgacggacatcaagcttgctttccgccgcctcgcgctctcgctccaccccgacaagcagccccccggctccgacctcgccgccgccaccgccgccttccaggagctgtactgtgtggcgtgcaataaaaagttcacatcggacaaacagtggcaga

SEQ ID NO: 332 - DNA, 260 bp, Zea mays
  unsure (1)..(260): unsure at all n locations
gcgacatcagagaagaaggaatacccagtggatgcatcgcttccggacatcaagaacagcatctatgcttctgatgagttccgcatgtaatcgttcaaggttcgcccttgctcacgggcatactctcatgactggactgagtagccctttgtccacccaggagagaatgctcggcgccgagacccccgcaagtaacattacagttgtgtgccatgcccagatttcaggaanggtgtgtggcgtcgcggagacatgtgtga

SEQ ID NO: 333 - DNA, 305 bp, Zea mays
agatgatggaattgactggtcttctaatcaaaatttgataaaccagacatcattgaaacctgtggatctccctatttgttcttttgctgctgctggtaattgtccttatggggaagggtgccctcaaatgcatggagatctgtgtgcaacctgtggaaaactgtgcttgcatccttatcgtcctgatgagacggaggagcatatcaagttatgtgagaaaaatcacaaacgccttgtagctctgaaacgcagccaagaaatagaatgcagtgtatgtttggatcgtgtgctttcaaagcctactg

SEQ ID NO: 334 - DNA, 267 bp, Zea mays
gacgatctcgggaggctggactgcgggcacgacttccatgctggctgcatcaagcaatggctggtggtgaagaacgtgtgccccatctgcaagaacaccgcattgaaggcctgaaaccgaacaaaggcccgtcagagacacacccatgttccgtgtccattcgatcggtcgcaagatcatttacccgattggtttttactatgcgttttttggttgggaaaatttgccatttcacctgggaaagtggtgggggggtgttggaggtgg

SEQ ID NO: 335 - DNA, 273 bp, Zea mays
ggcaagcagggcaggtggcggcgggggcgcactccggcgggcgggaagaagcgcgggcgcacggcgggggacaaggagcagaaccggctgaagcggctgctgcggaaccgcgtgtccgcgcagcaggcgcgggagcggaagaaggcgtacctgacggagctggaggcgaaggccaagggcctggagctccgcaatgcggagctggagcagcgggtgtacacgctccagaacgagaacaacacgctccgccagattctgaagaacacgacggcg

SEQ ID NO: 336 - DNA, 276 bp, Zea mays
agcaagtatatcaagaattgtcatgttaactgaggcgctatttgaggtgttggatgaaattcaccgtcaacctgcatcactttcactttccatggtgtctgttcaggctcctgaatctgtagttgattcgttgccatgtgccatatctgcctaaccgaatatgaggacggagaccagataagaacccttccgtgcaagcacgagttccacctgcaatgcgttgacaagtggctgaaagaaatacacagggtgtgccctctgtgccgtggagacgtc

SEQ ID NO: 337 - DNA, 294 bp, Zea mays
aagatgagcactcctcaaaatcagatgatgacatggatgaccttgaagagttggatatctcgtcgtgtttcatgtgtgacctcaagcatgacaccatagaagactgcatggtccatatgcataagaagcatgggtttttcatacctgacagtgaatacttgaaggatcccagtggtcttcttacttatgttggactgaaggtgaagcgtgattttatctgcctctactgcaatgacagatgccagtccttcttcagtctagaggctgtcaggaagcacatggatgcaaaggggc

SEQ ID NO: 338 - DNA, 266 bp, Zea mays
aacgagattcagtttgctggacaactccaacccaagggatgctgctacagcttggagagttccgttggggcagagtgagatgctgaatcgtcaggtcgtgaagtctgattcagcgattatcaagattccagagctcgactttgagatccctccagaagctcaacgtggaacactttctactgtggaagggattattatgcgagctgtggatgagctgcaggctcttcaagatgaacggaagaaagtggatcctcagaaggccgaag

SEQ ID NO: 339 - DNA, 284 bp, Zea mays
atttatgcaaagaggcgtatatatgccggtgaggaaatcacatataattacaaatttccattggaggaaaaaaagataccgtgccattgtggttctcggaggtgtcgtggatcaatgaactaagaaggccatcttttgaggttgctgcaacacttaagattcttggctgtgtgcaactcatcaatcaggatttacatcaatatcaaaatatggagtgcacgaacatgctggacagcaagaacaaactgccgcattatacttatttaagctatattggtcagact

SEQ ID NO: 340 - DNA, 295 bp, Zea mays
gattcttccttttattgagcttgaccttaaggaaattgcacaaactttttctaagtttgcctgcaatgcgcataccatatgtgaccctgaacttaggcctcttgggactggactgtaccctgtcatatccattattaaccacagttgtgtaccaaatgcagttttgatatttgatggtaggacagcatatgttcgtgcattgcaaccgataaataaagatgaagaggtatctataagctacattgagactgcggcagtcaccaagaagagaaacaatgatctgaaacagtacttc

SEQ ID NO: 341 - DNA, 266 bp, Zea mays
cgttgatggagacgatctcgggaggctggactgcgggcacgacttccatgctggctgcatcaagcaatggctggtggtgaagaacgtgtgccccatctgcaagaacaccgcattgaaagcctgaaaccgaacaaaggcgacacacccatgttccatgtccattcgatcggtcgcataatcatttacccgattggtttttactatgcgttttttggttgggaaaatttgccattcacctgggaaagtggtgggggggtgttggaggt

SEQ ID NO: 342 - DNA, 282 bp, Zea mays
atgtgggagaaagtcagtccagcgctacagcgtgcagtgcaaagccagatgagtctaatgagcacaccgttcatcgacaacaatgacctttttgaaactggcagtacaggaggcatgtcaagggctctgattgataggatcccaaagatgaggttcagtgctgcaagcaattgtgacaaggaaactgatagcagctgctgctcagtctgcctgcaggattttggagcacagcaatttgtgagggccctgcctcagtgccaacacatattccatgtgcggtgc

SEQ ID NO: 343 - DNA, 274 bp, Zea mays
acttgaggggcacgtcctagatcggtggcgcctgcctctcgccgccggtacggtgcctctcgcggtctcgctccccctcgcaggtcttttggtgttttttagttcctccctttgcttcttggaggtgtttgttgccgtctcacccgcagttcttgagcaatggagatggctcgacttatatgtggtggctgccagacattattgctgtatgctcgcagtgcaacaactgtaagatgctcatgttgtgacacagtcaatcttgtcagaccagtga

SEQ ID NO: 344 - DNA, 259 bp, Zea mays
  unsure (1)..(259): unsure at all n locations
cgggagtccgccgcgcgtgcgttcgacctcaacctcccggccgtgccgaagtacgtgttccggtgcggcaagcccggcagatgtgggaggaggacgaggaggtgcagagccccctcgccttcaagaagccccgcctcctacatgaccgcgtgaaaccgctgcgagcgcgggcggcggatctcatctcatcacccgtccaagattttggtccgcagctgccgagttcagcggtnggaagtggaacacactattcgttcat

SEQ ID NO: 345 - DNA, 247 bp, Zea mays
cagacttctgctgcagcgcctccgccgccgccgccgcatctaacgcagttccctccgacgcaagccgaggaacgatggtgctccaggacgacattgatctgctcaacccgccggcagaactcgagaagctcaagcacaaggggaagagactcgtccagtcgcccaactccttcgtcatggatgttaagtgccaggggtgcttcagcataaccactgttttcagcgactcccagactgttggtgtgtg

SEQ ID NO: 346 - DNA, 284 bp, Zea mays
gcgagaaagagcgcgccgcctgcacgactggactggagcggccgggtgccctggaggcccctgggaattgcagtccttgcgcaggtggagagtgagcccttatgagaaaactcaagactcagaaacaataaaggttacagagatgaaattgacagagcctgaatttcaggttatgattctgtatggtttctttggtgctgcattagacctgaactctgattgaaaattcttccacgctcgctacattcttaaactttatctccaatatgaatttccagatgcct

SEQ ID NO: 347 - DNA, 274 bp, Zea mays
tcgcgaactgcaccggaaggagaaggagagaagcgagagtctccccagccagagcaagccgaatccgaagctagcggagaggagagagggctgagtgaggatgccgacggttacctgcaacgcgtgcaacgcggggttcgacgacgaggagcagcagcggcttcactaccgctctgaatggcacctttacaacctcaagcgcaaggtggctggagttcctggtgtcacagaggctctgtttctggctaggcagctgctttggcggaggggagca

SEQ ID NO: 348 - DNA, 139 bp, Zea mays
agcagggatgcacaagatgccattcgcgatttggatggtaagaatggttggagggttgagctgtcaaccaaagatggtggtggccgtgcgagaccgtaatggtctgatatgagtgctatgagtgtggtgaagttggcac

SEQ ID NO: 349 - DNA, 207 bp, Zea mays
agatgatgtaaatgaccgaggccctataatgttaaatgaagcactggaactgttgagccaacggtgggacaggataaatggtgctcaggctcttaggctgttaccaagagatactaaactccaggatcttgtatcatttcttgagccactattgcgtaactctagtgaacatcggcgcaattatttggttatcaaaaacttgatttt

SEQ ID NO: 350 - DNA, 266 bp, Zea mays
ccgatcttttcgtgatgtctaatcccatgagagaagtcacactggagagaaaccctttgtgtgtacagaatgtgggaaagccttcagttattatagctctttccatagacacagaagaactcaccagacagtaaccttgaacacagagcttgagaagacttcataacacccataagattgcatatggagtaaaactgtaaaagttaagcgagtgaaacacctggttctactcatgggtacaggacctttaggccagacatggtgtg

SEQ ID NO: 351 - DNA, 267 bp, Zea mays
ggggcattgcaagttgcggtatggagatggtggagatgatgaagatgctgacctcgaggaattctatgattacagcagcagttatgttgattcagaaggcaagcagttgatgctgttgatgacttgaacaacaacattgagctgggaatcggtgggtctgagctagtaataacaaacaagagcgagaaaggcactcgggtcagaacccttggctctagggaatttatgcgctactatcgccagaaaccacggccttctgttgcacca

SEQ ID NO: 352 - DNA, 294 bp, Zea mays
gtaatgttaatgcatctgccattaatgttataaataccatcagtttgcaggaagtgcatatcagaggagtttgtaaataaggaagtgtgctgctgccctgtttgtagcattgacttgggctgtgctccactggagaaactcagaattgatcatagcctacagtatgtaaggtcaaaggtatttccttctaaaaaacgaaaggttgaggatccagaagtcacatcgccaattacatcacctataaagacgaaagtacggtctttatcttctttgacaaaacatgctcctcaaatg

SEQ ID NO: 353 - DNA, 308 bp, Zea mays
ctttgaggctactctttccttgcaagatcagcttaaagaatctcaagttgctctcttggtggagcaggagaaggcggaggcggctgtaaaagaggctgacgtcgccaaagcagcatgggcatgccgtatctgcctgaatgctgaggtcaacatgaccatcataccatgcggtcatgtcctatgtaaccgatgctcaagttcggtttcgcggtgcccattttgccggacgcaggtggccagaatgatgaaaatattcaggccataaaaaacattgaaggacgtttggtctgactaaccgcttcagcttg

SEQ ID NO: 354 - DNA, 260 bp, Zea mays
ggaaattttcatcgtggagactaacagcatctttggacccagaaccatgctgtatttgccaggaggcgtacgttgatggagacgatctcgggaggctggactgcgggcacgacttccatgctggctgcatcaagcaatggctggtggtgaagaacgtgtgcaccatctgcaagaacaccgcattgacagcctgacaccgaacaaaggcgacacacacatgttccatgtccattcgatcggtcgcacgatcatttacccga

SEQ ID NO: 355 - DNA, 265 bp, Zea mays
caaaaccctccctgctcagactcgtctgctgcagctcctcctccgccgccgtatcaaacgcactctccttcgccgccgtatcaaacgcactctcctccgccgccgcctgatgcaagatggttctccagaacgacatcgaccttctcaacccgccggcagagctcgagatgctcaagcacaagaagaagcgcctcgtccagtcccccaactcattcttcatggatgacaagtgccagggatgcttcagcataaccacgggtttcag

SEQ ID NO: 356 - DNA, 251 bp, Zea mays
catgatgattattgtgaccccacaagcacccccctcaccttacaattatcaacggctttgtataataatagcagcagcattaggagtactattaatgctaaagctaaagttcatgagtgttccatatgtggggcagaattttcatctgggcaagcgttggggggacacatgagaaagcatagaaattttctgagtgcacctattattgggcaattaatattgcaatggtggtgatggaagcctaaagtccg

SEQ ID NO: 357 - DNA, 258 bp, Zea mays
ccgggcagcccagaaccagaggagggagccgccattgctgcagatccccaggagcttcttgagggttagagaggggaggatgacagttagagtagtgatgaggtaccttgttaacaagctgggccttgacgacgattcacagttagagattacctgtcgagggcaacaccttcaaccgacaatgacgctgcagcaggtccgtgacaccatttggcggccagtgccggctgaggctgcagcggttttgccggcccccgg

SEQ ID NO: 358 - DNA, 276 bp, Zea mays
cgcagggccaattggcagtccttgcggatgaggacaaataatttgatacgaggagataatgccagactggagtgtggcttaaagaaggagatgcgggaaatgttgccagttgttatcttcaaagagagtttcttgatcagggagacacagtgctcggtctgcctagcagaatacgaaccggacgggatgcttcataagatacctccctgtgggcataccttccacatcaactgtatcgaccactggctctccacaaacaccacctgccccctctgc

SEQ ID NO: 359 - DNA, 287 bp, Zea mays
ctcaaagcccttatttggaagccatgggggccatcgaaatgcaaactattcgcttggcttatcatccgcaaccgggtttggacctctgataggctcgcagctcgtggatggccgcacagtccttcttgtccgctttgcaagcggcaccctgagacagctcatcacattattgctggttgccgcttctcgaggagaatttgggacgccctagcatcttggctctccattggccctttagctccagctacctggccggactctacttccatcaagcagtggtggtttat

SEQ ID NO: 360 - DNA, 249 bp, Zea mays
gtcaactgattcaccggcgggtatctgacatacgtgagtctcaatatgagaagagtgggattggaagcagttacctctttcgcttggatgatgattttgtggtcgatgccactaagcgtggtgggttagcaaggttcataaatcattcttgtgagccaaattgctacacaaaggtgatcactgttgatggacagaagaagattttcatttatgcaaagaggcgtatatatgccggtgaggaaatcacat

SEQ ID NO: 361 - DNA, 284 bp, Zea mays
gctgcatctgtcttacgaagtatggagatgatgatgagcttcgtgagcttccttgcacacacttctttcatgttcaatgtgtagataaatggcttaagataaatgcggtgtgcccactctgcaaaacagagattgggggtgtggttcgatctttctttggcttgccatttggccgccgccgtgtcgataggatagcggcaagaggtatagctagctcaagattcagtgtatagaacaatgctgtttttccgcataaagagctctgctctgttgcaatggtttga

SEQ ID NO: 362 - DNA, 276 bp, Zea mays
gagagggtgggccatgcggagatcccgaccagtttcggtcccgagctgcgcgcctgcctccgatgactcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattcctgggtgctatacacttgctgtctcg

SEQ ID NO: 363 - DNA, 307 bp, Zea mays
cagaagcaggggctagacgcggatcggcgagcatgacgcgcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaat

SEQ ID NO: 364 - DNA, 282 bp, Zea mays
cgcggatcggcgagcatgaggggcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttgg

SEQ ID NO: 365 - DNA, 311 bp, Zea mays
gagagagcaggaagcaggggctagacgcggatcggcgagcatgaagagcggcggcggcggcgggatgatggcacatgaagagagggtgggccatgcggagatcccgaccagtttcggtcccgagctgcgcgcctgcctccgatgccgcctcgtcaagacctacgaccagttcagggagaccggctgcgaaaacagcccgtttctagagatggacagagagcacgacaacgtcgtcaacagcaccacacccaacttcactggagatatcactctgatggaccccagtaggagctgggcagcccgttggttga

SEQ ID NO: 366 - DNA, 287 bp, Zea mays
cgcggatcggcgagcatgaggcgcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaatctcgccaactgcaccacccccaacttcactggaattatctctctgatggaccccagtaggagctgggcagcccgttggttgag

SEQ ID NO: 367 - DNA, 367 bp, Zea mays
caggaagcaggggctagacgcggatcggcgagcatgaggggcggcggcggcggcgggatgatggacgatgaagagagggtgggccatgcggagatcacgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattcctgggtgctatacacttgctgtctcggaggagcttccagaagagt

SEQ ID NO: 368 - DNA, 442 bp, Zea mays
cccacgcgtccgcggacgcgtgggggaagcaggggctagacgcggatcggcgagcatgaggggcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattcctgggtgctatacacttgctgtctcggaggagcttccagaagagtatcaagggatttgtcaagacatcaacgtgcagtatgtgccgtccaagcgtgtc

SEQ ID NO: 369 - DNA, 311 bp, Zea mays
gctaaaccagcggaaacctaaccagctagcagcattagcttttcaacaagcctcgctcgcgcgccgtgaccgatagatggccatcacccacgacgactacgtctccctgtgcctcatggcgctcgcagccgctcggaggcggaggagggcacgctgcggctgccagtgccaggacgacgacgatgacgacgcaagagtgcgagctccgcttccggtgctccgtctgcggcaaggccttcgcgtcgcaccaggcgctgggcgggcacaaggccagccaccggaagccgccgccgacgctcgtaaaggcggcg

SEQ ID NO: 370 - DNA, 285 bp, Zea mays
agcttttcaacaagcctcgctcgcgcgccgtgaccgatagatggccatcacccacgacgactacgtctccctgtgcctcatggcgctcgcagccgcgggaggaggaggagggcacgctgcggctgccagtgccaggacgacgacgatgacgacgcaagagtgcgagctccgcttccggtgctccgtctgcggcaaggccttcgcgtcgcaccaggcgctgggcgggcacaaggccagccaccggaagccgccgccgacgctcgtacaggcggcgtcgtcgtcgtc

SEQ ID NO: 371 - DNA, 321 bp, Zea mays
tgctaaaccagcggaaacctaaccagctagcagcattagcttttcaacaagcctcgctcgcgcgccgtgaccgatagatggccatcacccacgacgactacgtctccctgtgcctcatggcgctcgcagccgctggaggaggagggcacgctgcggcagccagtgccaggacgacgacgacaatgacgacgcaagagtgcgagctccgcttccggtgctccgtctgcggcaaggccttcgcgtcgcaccaggcgctgggcgggcacaaggccagccaccggaagccgccgccgccgctcgcacaggcgccgtcgtcgtcgt

SEQ ID NO: 372 - DNA, 311 bp, Zea mays
acttgctaaaccagcggaaacctaaccagctagcagcattagcttttcaacaagcctcgctcgctcgccgtgaccgatagatggccatcacccacgacgactacgtctccctgtgcctcatggcgctcgcagccgcaggaggaggagggcacgctgcggcagccagtgccaggacgacgacgacaatgacgacgcaagagtgcgagctccgcttccggtgctccgtctgcggcaaggccttctcgtcgcaccaggcgctgggcgggcacaaggccagccaccggaagccgccgccgccgctcgcacaggcg

SEQ ID NO: 373 - DNA, 282 bp, Zea mays
ctaaaccagcggaaacctaaccagctagcagcattagcttttcaacaagcctcgctcgcgcgccgtgaccgatagatggccatcacccacgacgactacgtctccctgtgcctcatggcgctcgcagccgctggaggaggaggagggcacgctgcggctgccagtgccaggacgacgacgatgacgacgcaagagtgcgagctccgcttccggtgctccgtctgcagcaaggccttcgcgtcgcaccaggcgctgggcgggcacaaggccagccaccggaag

SEQ ID NO: 374 - DNA, 254 bp, Zea mays
gtatactcgcagtgcagacaccgtaagtgttcatgttgcaacacagtgaaccttgttagaccagtgaataatatagctcatgtgaactgcggccagtgccggacaactttgatgtatccatacggcgcaccttcagtaaaatgtgccgtatgcaattatgtcacagctactggagtaaatactgtggcacccaccccatctgcgaggccaacatcagatgggtcttcatatagtggctcatctacttctgctcc

SEQ ID NO: 375 - DNA, 243 bp, Zea mays
gtatactcgcagtgcagacaccgtaagtgttcatgttgcaacacagtgaaccttgttagaccagtgaataatatagctcatgtgaactgcggccagtgccggacaactttgatgtatccatacggcgcaccttcagtaaaatgtgccgtatgcaattatgtcacagctactggagtaaatactgtggcacccaccccatctgcgaggccaacatcagatgggtcttcatatagtggctcatct

SEQ ID NO: 376 - DNA, 303 bp, Zea mays
ctccacgccgtcgtcccggagaagcagagcgaggaggaggtcgcgcccgcagcgacgaccacgagcagcagcgccaccgccacgggcggggacgagggcgcccacgtgccccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgccgcggagttcaggtgctccgtctgcggcaagtccttcagctcctaccaggcgctggggggg

SEQ ID NO: 377 - DNA, 411 bp, Zea mays
ccacagcgagcgagagcaaggcgcccaagcaaccaccgcgagaacaagtcgcagccaaacagccccgtctcccagcgaagcttgagcttgcattattctaccatgtcttccatggagctgctccacgccgtcgtcccggagaagcagagcgaggaggaggtcgcgcccgcagcgacgaccacgagcagcagcgccaccgccacgggcggggacgagggcgcccacgtgctccaggggtgggccaagaggaagcgctcgcgccgccagcgatcggaggaggagaacctcgcgctctgcttcctcatgctctcccgcggtggccaccaccgcgtccaggcgccgccaacgccggtcccgtccgcggcgccggccgccgcggagttcaggtgctccgtctgcggcaagtccttc

SEQ ID NO: 378 - DNA, 382 bp, Zea mays
ccacagcgagcgagagcaaggcgcccaagcaaccaccgcgagaacaagtcgcagccaaacagccccgtctcccagcgaagcttgagcttgcattattctaccatgtcttccatggagctgctccacgccgtcgtcccggagaagcagagcgaggaggaggtcgcgcccgcagcgacgaccacgagcagcagcgccaccgccacgggcggggacgagggcgcccacgtgctccaggggtgggccaagaggaagcgctcgcgccgccagcgatcggaggaggagaacctcgcgctctgcttcctcatgctctcccgcggtggccaccaccgcgtcaaggcgccgccaacgccggtcccgtccgcggcgccggccgccgcggagt

SEQ ID NO: 379 - DNA, 241 bp, Zea mays
cggacggtgggtgcagatcaaggagaaggctctgttcgactgcgagcgtggagcggcaccaaaggcgacgccggaccagttcaagtgtgccagatgtgggcagcggaagacgacttactaccagctgcagactcggagtgctgatgaaccgatgacgacgttcgtcacatgcgtgaactgcaacaatcactggaagttctgctgagtgttcagccttgctaaagtgtttacttagttgtgc

SEQ ID NO: 380 - DNA, 285 bp, Zea mays
aggaccagttcaagtgtgccagatgtgggcagcggaagacgacttactaccagctgcagactcggagtgctgatgaaccgatgacgacgttcgtcacatgcgtgaactgcaacaatcactggaagttctgctgagtgttcagccttgctaaagtgtttacttagttgtgctgagcacactatcctgctgtgatgtgtgtgctctgttagttgtgactggaagttcgacagggcaggctgaacaactcaacttttttccccttttttaccccccgtaaactaggag

SEQ ID NO: 381 - DNA, 268 bp, Zea mays
gatcactctctgctgaagacgcagtttgctgcatctgtcttgcaaaatatgcgcacaatgatgagctccgtgaacttccatgtgcacactgtttccacaaggactgtgttgataaatggctcaagataaatgcactttgccctctgtgcaaatctgagatagtgagctcgtctggtatctctgatgcccgccaatcagaccagaacaccgttcctgtgcaggagatcgaaatgcattaggttggtctgttcccgcagcttatcacata

SEQ ID NO: 382 - DNA, 255 bp, Zea mays
gaatctatcaatgctttgcctacatataaattcaacatcaagaaacgtcgccatggttcaggcagtgaaactgaaggccaggaaggagggatattggctgcaggaactgacaaggagcgatcactctctgctgaagacgcagtttgctgcatctgtcttgcaaaatatgcgcacaatgatgagctccgtgaacttccatgtgcacactgtttccacaaggactgtgttgataaatggctcaagataaatgcactt

SEQ ID NO: 383 - DNA, 254 bp, Zea mays
gtcgccatggttcaggcagtgaaactgaaggtcaggaaggagggatattggctgcaggaactgacaaggagcgatcactctctgctgaagacgcagtttgctgcatctgtcttgcaaaatatgcgcacaatgatgagctccgtgaacttccatgtgcacactgtttccacaaggactgtgttgataaatggctcaagataaatgcactttgccctctgtgcaaatctgagatagtgagctcgtctggtacttct

SEQ ID NO: 384 - DNA, 236 bp, Zea mays
ctggttttctctgcgcggggaagaatggcgtcgtggttggagcagctgcagcgcgagctcgccgcccgcggcctcacagtcgcctccatccccggcaagggaaggggtctcatcgctacttgcaccttcttcccaggggatgtcattctcaatcaggaaccttacgcttctacacctaacaagattttagttggatcgagctgtgaccactgtttcacctctggcaacctgaggaa

SEQ ID NO: 385 - DNA, 308 bp, Zea mays
ggagcagctgcagcgcgagctcgcacgcccgcggcctcacagtcgcctccatccccggcaagggaaggggtctcatcgctacttgcaccttcttcccaggggatgtcattctcaatcaggaaccttacgcttctacacctaacaagattttagttggatcgagctgtgaccactgtttcacctctggcaacctgaggaagtgctctatgtgtcgagttatgtggtactgcagcagcaactgtcagaaagaagaatggaaactacatcagcttgagtgtagagcaatggcagcacttacagaggataga

SEQ ID NO: 386 - DNA, 307 bp, Zea mays
ccactggcctgtatctcactttcacgttgacatcagtcgcagaaaaggttcaatcatttatgacggcactgagagcgttatctcataaagacttccattgtggctcatatgcaacaagcgagcaggtggctgctgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttacgtgacggttc

SEQ ID NO: 387 - DNA, 278 bp, Zea mays
tgaccaagctccctttttgaagaaagtcctcgacaaatgttccatagtctcatgggggagagggacagacatagacacataaccatggaaggaattacagaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaat

SEQ ID NO: 388 - DNA, 193 bp, Zea mays
acggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcgtgtaccagtggcttcatgcacattcaccccagtct

SEQ ID NO: 389 - DNA, 214 bp, Zea mays
ttcaggttttcattgcttgtggtttagggaaaggaaaaggtattccagatgatccataccgcaaaccaaatcctggaatgtggtggttgatggctcagcatttcaattctggaatcaaaattgacatggatcaatctttctatgtcggtgatgctgctgggagagagaacgatcatagtgacgcagatatagaatttgctaaggccatcggtct

SEQ ID NO: 390 - DNA, 325 bp, Zea mays
cttgtgttagaagcaatgagcaccagggaattgggtttctcaatgagccgcgcaggttaaacgttgcgttaactcgtgcacgttatggcatagttattcttggtaatccaaaagtactaagcaagcagccactttggaatagcttgttgacacattacaaggagcatgagtgcttggtagaaggacctctgaacaacttaaagcagagcatggtgcagtttcagaagcccaaaaagatatataatgatcggagattgttactgggcggtgctcaaggcatgcatggagctaacttcggggctggggcctcaagccaagcagcaga

SEQ ID NO: 391 - DNA, 296 bp, Zea mays
gaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactg

SEQ ID NO: 392 - DNA, 290 bp, Zea mays
gaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacatcgtgccca

SEQ ID NO: 393 - DNA, 287 bp, Zea mays
cctagatcggtggcgcctgcctctcgccgccgatacggtgcctctcgcggtctcgctccccctcgcaggtcttttggtttttttagttcctccctttgcttcttggaggtgtttgttgccgtctcccccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggc

SEQ ID NO: 394 - DNA, 413 bp, Zea mays
acaccagtctgccgcagtgccgcaccccgcacgagacgcgtccttgaggggcacgtccgagatcggtggcgcctgcctctcgccgccgatactgtgcctctcgcggtctcgctccccctcgcaggtcttttggtttttttagttcctccctttgcttcttggaggtgtttgttgccgtctcagccgcagttcttgagacatgcagagccagatagtgtgccacgggtgcaagacccttctgttctacgcaaaaggtgctccgaacgtgtgttgtgcggtatgccatgtggtcaacaatgtgcagcctccagcaatggacatggctcgacttatatgtggtggctgccagacattattgatgtatgctcgcagtgcaacaactgtaagatgctcatgttgtgacacagtcaatc

SEQ ID NO: 395 - DNA, 422 bp, Zea mays
tacccacacttctgcgagacccgtccttgaggggcacgtcctagatcggtggcgcctgcctctcgccgccgatacggtgcctctcgcggtctcgctccccctcgcaggtcttttggtttttttagttcctccctttgcttcttggaggtgtttgttgccgtctcacccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttagatgtggtggctgccagacattattgatgtatgctcgcagtgcaacaactgtaagatgctcatgttgtgacacagtcaatcttgtcagaccagttagtagcatagct

SEQ ID NO: 396 - DNA, 392 bp, Zea mays
cacccgtctgccgctgtgccgcacggccctcaccccgcacgagacccgtccttgaggggcacgtcctatatcggtggctcctgcctctcgccgccgatacagtgcctctcgcggtctcgctcccactcacaggtctattggtttttttagttcctaccttagcttcttggaggtgtttgttgccgtctcacccgcagttcttgagacatgcagagccagatagtgtgccacgggtgcaggacccttctgatctacccaagaggtgctccgagcgtgtgttgtgcggtatgccatgtggtcaccaatgttgccgcttcagcaatggagatggctcgacttatatgtcgtggcttgcagacattattgatgcatgctcgcagtgcaacaactgt

SEQ ID NO: 397 - DNA, 269 bp, Zea mays
cgaatatgaggacggagaccagataagaacccttccgtgcaagcacgagttccacctgcaatgcgttgacaagtggctgaaagaaatacacagggtgtgccctctgtgccgtggagacgtctgcgaagtcgcctcgtgaagaccttggcgctgccatccttccgatgtggcgccggtggatagggcaccaccgccaggcgccagctgttccgtggttgaagctggttcggtcaggcaatggtgatccaacttggacagttgacaccgca

SEQ ID NO: 398 - DNA, 248 bp, Zea mays
cgaatatgaggacggagaccagataagaacccttccgtgcaagcacgagttccacctgcaatgcgttgacaagtggctgaaagaaatacacagggtgtgccctctgtgccgtggagacgtctgcgaagtcgcctcgtgaagaccttggcgctgccatccttccgatgtggcgccggtggatagggcaccaccgccaggcgccagctgttccgtggttgaagctggttcggtcaggcaatggtgatcca

SEQ ID NO: 399 - DNA, 280 bp, Zea mays
gagacaccccaatgcagtgatgatatggaacagtgccatatctgcctaaccgaatatgaggacggagaccagataagaacccttccgtgcaagcacgagttccacctgcaatgcgttgacaagtggctgaaagaaatacacagggtgtgccctctgtgccgtggagacgtctgcgaagtcgcctcgtgaagaccttggcgctgccatccttccgttgcggcaccggtggatagggcaccaccgccaggcgccagctgttccgtggttgaagctggttcgg

SEQ ID NO: 400 - DNA, 266 bp, Zea mays
gagacaccccaatgcagtgatgatatggaacagtgccatatctgcctaaccgaatatgaggacggagaccagataagaacccttccgtgcaagcacgagttccacctgcaatgcgttgacaagtggctgaaagaaatacacagggtgtgccctctgtgccgtggagacgtctgcgaagtcgcctcgtgaagaccttggcgctgccatccttccgttgcggcaccggtggatagggcacaccgccaggcgccagctgttccgtggtt

SEQ ID NO: 401 - DNA, 252 bp, Zea mays
actattagcacttgaggaaaggatcggaaatgttagcactggcctcagcgaggaagctgtgataaagttgctcaaacaaaggaaattttcatcgtggagactaaaagcatctttggacccagaaccatgctgtatttgccaggaggagtacgttgatggagacgatctccggaggctggactgcgggcacgacttccatgctggctgcatcaagcaatggctggtggtgaagaacgtgtgccccatctgcaa

SEQ ID NO: 402 - DNA, 284 bp, Zea mays
aggaaatgtcggcactggcctcagcgaggaagctgtgataaggttgctcaaacaaaggaaattttcatcttggacactaaaagcatctttggaccctgaaccatgttgtatctgccaggaggagtacgctgatggagacgacctcgggaagctggactgcgggcacgacttccacgctggctgcatcaagcaatggctggtggtgaagaacgtgtgccccatctgcaagagcaccgcattgaagaagacctgaaacccgaacaaaggctcgtgtcagagacatc

SEQ ID NO: 403 - DNA, 284 bp, Zea mays
aggaaatgtcggcactggcctcagcgaggaagctgtgataaggttgctcaaacaaaggaaattttcatcttggacactaaaagcatctttggaccctgaaccatgttgtatctgccaggaggagtacgctgactggagacgacctcgggaagctggactccgggcacgacttccacgctggctgcatcaagcaatggctggtggtgaagaacgtgtgccccatctgcaagagcaccgcattgaagaagacctgaaacccgaacaaaggctcgtgtcagagacat

SEQ ID NO: 404 - DNA, 123 bp, Zea mays
ggactgtggtcacgacttccacaccgcatgcatcaaacaatggctggttataaaaaatgtgtgcccaatctgcaagaaaacagcactggacgcctaagacatggctgcattttccctccctag

SEQ ID NO: 405 - DNA, 312 bp, Zea mays
cggacggtgggcggacgcgtgggcaagtgttctttggtacttctcaaaggaagagaaagaggagatcactgaaagctacaaatccaagctcaagtctattgattacaagtacttcgactttgggactggctcatgccccttcggaacaagttgtttctataagcatgcctacagagatggccgcttggaagaggtaatactgcggcatcttgatgctgatgatggaagtacagtaattgcaaaaagtatcaggttatcagacttccttggtaggatggatctttagggaccagcagctgtattgatatcaaa

SEQ ID NO: 406 - DNA, 261 bp, Zea mays
gatgtgaactcagcattgagggcttgtccaatatgtcggaaactttcatactatgtcattccaagtgttctttggtacttctcaaaggaagagaaagaggagatcactgaaagctacaaatccaagctcaagtctattgattgcaagtacttcgactttgggactggctcatgccctttcggaacaagttgtttctataagcatgcctacagagatggccgcttggaagaggtaatactgcggcatcttgatgctgatgat

SEQ ID NO: 407 - DNA, 303 bp, Zea mays
cccgtccttctccttcccatcggctccacacaaccagaaggttcttcgcttcactctgccctgcgccgccgccaacgctgcagccgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgaca

SEQ ID NO: 408 - DNA, 258 bp, Zea mays
agaacagacaacccgtccttctccttcccatcggctccacacaaccagaaggttcttcgcttcactctgccctgcgccgccgccaacgctgcagccgcagttgccgcaagcgggaacttggacgtgctactcgcgactgctctcatctgttcccgcgtaggattcgttcacaatggcccgtgtgtatgtcggcaacttggatgcacgcgtgacttccggggaactcgaagatgagttccgacgtgtttggagttctgc

SEQ ID NO: 409 - DNA, 292 bp, Zea mays
cgccgccaacgctgcagccgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgacaggagggatgcagaggatgctattcgtgatctagatggtaagaatggatggaaagt

SEQ ID NO: 410 - DNA, 309 bp, Zea mays
cccatcggctccacacaaccagaaggtagttcgcttcactctgccctgcaccgccgccaacgctgcagtcgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgacaggagggatgcagaggatgcta

SEQ ID NO: 411 - DNA, 260 bp, Zea mays
acgctgcagccgcagttgccgcacgcgggaacttggacgtgctactcgcgactgctctggtcggttcccgcgtaggattcgttcacaatggcccgtgtgtatgtcggcaacttggatgcacgcgtgacttccggggaactcgaagatgagttccgtgtgtttggagttctgcgaagtgttcgggtcgcacgcaaaccacctggttttgcatttattgattttgactacaggatggatgcagaggatgctattcgtgatct

SEQ ID NO: 412 - DNA, 240 bp, Zea mays
gcacgaggagagagagagagagagagagagagagagagagagagagagcccgaggcaagatggttctccagaacgacatcgaccttctgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggct

SEQ ID NO: 413 - DNA, 234 bp, Zea mays
gcacgaggtccagtcccccaactccttcttcatggatgtcaagtgccagggctgtttcagcataaccactgtgttcagccactcccagactgtggttgtgtgcccaggctgccaaactgttctgtgccaacctaccggtgggaaggccaggctcaccgaggggtgctccttccgtcgcaagggcgattaggtcctgcttctcttaacgtgagaagagataaatttggtgttttg

SEQ ID NO: 414 - DNA, 257 bp, Zea mays
gcacgaggagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtggcaacctaccggtgggaaggccaggctcaccgaggggtgctccttccgtcgcaagggcgattaggtcctgcttctcttaacgtgagaagagataa

SEQ ID NO: 415 - DNA, 242 bp, Zea mays
gcacgaggtggaaaggtagtgtaatggattaattaatgtttttttttgcagaaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagcta

SEQ ID NO: 416 - DNA, 216 bp, Zea mays
tgccgtccgcgcaaaaccctccctgctcagactcgtctgctgcagctcctcctccgccgccgtatcaaacgcactctcctccgccgccgcccgaggcaagatggttctccagaacgacatcgaccttctgaacccgccggcagagctcgagaaactcaagcacaagaagaagcgcctcgtccaatcccccaactccttcttcatggatgtcaagtg

SEQ ID NO: 417 - DNA, 270 bp, Zea mays
cagacttctgctgcagcgcctccgccgccgccgccgcatctaacgcattccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctg

SEQ ID NO: 418 - DNA, 272 bp, Zea mays
cagacttctgctgcagcgcctccgccgccgccgccgcatctaacgcattccctccgccgcagccacaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgcc

SEQ ID NO: 419 - DNA, 321 bp, Zea mays
ccgaggcaagatggttctccagaacgacatcgaccttctgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggataggagactagagtggagtctgttattagtactggatcggttgtcaatctccagtatgtgg

SEQ ID NO: 420 - DNA, 288 bp, Zea mays
gacttctgctaggacgcctccgccgccgccggcgcatctaacgcattctctccgccgcagcccgaggcaagatggtcctcagaacgacattgatctgctcaacccggcggcagaactcgagaagctctagcacgagaaaaagagactcgtccagtctgccaactccttcttcatggatgttaagtgccagtggtgcttcagcatgaccactgttttcagccactcccagactgttgttgtgtgcctggctgcaaactgtcctctgccaaccacaggacgaaaggcaag

SEQ ID NO: 421 - DNA, 326 bp, Zea mays
cttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttcccgcagaagggag

SEQ ID NO: 422 - DNA, 270 bp, Zea mays
tctgctcaacccgccggcagaactcgagaagctcaagcacaagaaaaagagactcgtccagtcgcccaactccttcttcatggatgttaagtgccaggggtgcttcagcagatcaatgtcgttctggagaaccatcttgcctcgggctgcggcggagggaagatggttctccagaacgacattgatctgctcaacccgccggcagaactcgagaagctcaagcacaagaaaaagagactcgtccagtcgcccaactccttcttcatggat

SEQ ID NO: 423 - DNA, 307 bp, Zea mays
cccacgcgtccgcggacgcgtggggacttctgctgcagcgcctccgccgccgccgccgcatctaacgcattccctccgccgcagcccgaggcaagatggttctccagaacaccattgatctgctcaacccgccggcagaactcgagaagctcaagcacaagagaaagagactcgtccagtcgcccaactccttcttcatggatgttaagtgccaggggtgcttcagcataaccactgttttcagccactcccagactgctgatgtgtgcctggctgccaaactgtcctctgccaacccacaagagga

SEQ ID NO: 424 - DNA, 297 bp, Zea mays
tgctgcagcgcctccgccgccgccgccgcatctaacgcattccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagg

SEQ ID NO: 425 - DNA, 189 bp, Zea mays
gctgcagcgcctccgccgccgccgccgcatctaacgcattccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtg

SEQ ID NO: 426 - DNA, 323 bp, Zea mays
acgcactctcctccgccgccgcccgaggcaagatggttctccagaacgacatcgaccttctgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggctgccaaactgttctctgccagctcacgggaggaaaggcgaggctcacggagggatgctctttccgccggaagggagactagagtggagtctgttattagtactggatcggt

SEQ ID NO: 427 - DNA, 226 bp, Zea mays
gttctccagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggatatgcgaggctcacgg

SEQ ID NO: 428 - DNA, 278 bp, Zea mays
cccacgcgtccgcctgctcagactcgtctgctgcagctcctcctccgccgccgtatcaaacgcactctcctcagccgccgcccgaggcaagatggttctccagaacgacatcgaccttctgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggctgccaaa

SEQ ID NO: 429 - DNA, 273 bp, Zea mays
cccacgcgtccgctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgcca

SEQ ID NO: 430 - DNA, 277 bp, Zea mays
ctcgcctttgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaaccta

SEQ ID NO: 431 - DNA, 305 bp, Zea mays
actccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggttt

SEQ ID NO: 432 - DNA, 294 bp, Zea mays
atcaaacgcactctcctccgccgccgcccgaggcaagatggttctccagaacgacatcgaccttctcaacccgccggcagagctcgagaagctcaagcacaagaagaagcgcctcgtccagtcccccaactcattcttcatggatgtcaagtgccagggatgcttcagcataaccacggttttcagccactcccagactgttgttgtgtgcccaggctgccaaactgttctctgccagcccacgggaggaaaggcgaggctcacggagggctgctctttccgccggaaaggaga

SEQ ID NO: 433 - DNA, 286 bp, Zea mays
accttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccaggctcaccgaggggtg

SEQ ID NO: 434 - DNA, 283 bp, Zea mays
gccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctt

SEQ ID NO: 435 - DNA, 274 bp, Zea mays
gccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaagtgcaggctcactgagg

SEQ ID NO: 436 - DNA, 264 bp, Zea mays
atcaaacgcactctccttcgccgccgtatcaaacgcactctccttcgccgccgtatcaaacgcactctcctccgccgccgcccgaggcaagatggttctccagaacgacatcgaccttctcaacccgccggcagagctcgagaagctcaagcacaagaagaagcgcctcgtccagtcccccaactcattcttcatggatgtcaagtgccagggatgcttcagcataaccacggttttcagccactcccagactgttgttgtgtg

SEQ ID NO: 437 - DNA, 263 bp, Zea mays
cagacttctgctgcagcgcctccgccgccgccgccgcatctaacgcattccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactg

SEQ ID NO: 438 - DNA, 253 bp, Zea mays
cagactcgtctgctgcagctcctcctccgccgccgtatcaaacgcactctcctccgccgccgcccgaggcaagatggttctccagaacgacatcgaccttctgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggc

SEQ ID NO: 439 - DNA, 247 bp, Zea mays
cagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttcagtgccaggggtgcttcagcataaccactgttttcagccactcccagactgttgttgtgtg

SEQ ID NO: 440 - DNA, 198 bp, Zea mays
ctcgtccagtcgcccaactccttcttcatggatgttaagtgccaggtgtgcttcagcataaccactgttttcagccactcccagactgttgttgtgtgccctggctgccaaactgtcctctgccaacccacaggaggaaaggcatggctcactgagggctgctctttccgcagaagggatactagagcggatgtggtc

SEQ ID NO: 441 - DNA, 342 bp, Zea mays
tctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcagaagggagactagagcggatgtggtcttcaagttttgctctatgccagatactagcgtcatgaactgcctttagctgagattttccataagttgttctcgagcagctatgtgttgcat

SEQ ID NO: 442 - DNA, 345 bp, Zea mays
  unsure (1)..(345): unsure at all n locations
gttcaagatactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggagggagactagagcggatgtggtcttcaagttttcctctatgccagatactagcgtcatgaactgcctttagctaagattttccatagttgttctcgagcagctatgtgttgcatgttggctacttccanacttatatctggtttggtttggattgtgatg

SEQ ID NO: 443 - DNA, 121 bp, Zea mays
ctccgccgccgccgccgcatctaacgcagttccctccgccgcagcccgaggcaagatggttctccataacgacattgatctgctcaacccgccggcagaactcgagtagctcaagcacaag

SEQ ID NO: 444 - DNA, 360 bp, Zea mays
ctccgccgccgccgccgcatctaacgcagttccctccgccgcaacccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataccactgttttcagccactcccagactgttgttgtgtgccctggctgccaaactgtcctctgccaacccacaggaggaaaggcaaggctcactgagggctgctctttccgcagaagggagactagagcggatgtggtcttcaagttttgctctatgccagatactagcgtc

SEQ ID NO: 445 - DNA, 350 bp, Zea mays
ctccgccgccgccgccgcatctaacgcagttccctccgccgcagacccgaggcaagatggttctccagaacgacattgatctgctcaacccgccggcagaactcgagaagctcaagcacaagaaaaagagactcgtccagtcgcccaactccttcttcatggatgttaagtgccaggggtgcttagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagtgttgctctatgcca

SEQ ID NO: 446 - DNA, 349 bp, Zea mays
cagacttctgctgcagcgcctccgccgccgccgccgcatctacgcagtcgatccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcagaagggagactagagcggatgtggtcttca

SEQ ID NO: 447 - DNA, 339 bp, Zea mays
gcagcgctccgccgccgccgccgcatctaacgcattccctccgccgcagcccgaggcaagatggctctccagaacgacattgatctgctcaacccgccggcagaactcgagaagctcaagcacaagataaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcagaagggagatagagcggatgtggtcttcaagt

SEQ ID NO: 448 - DNA, 267 bp, Zea mays
gtccagtctcccaactcctttttcatggatgttaagtgccaggggtgcttcagcatatccactgttttcatccactcccagactgttgttgtgtgccctggctgccaaactgtcctctgccaacccacaggaggaaaggcaaggctcactgagggctgatctttccgcaggaagggagactagagcggatgtggtcttcaagttttgctctatgccagatactagcgtcatgaactgcctttagctaagattttccataagttgttc

SEQ ID NO: 449 - DNA, 327 bp, Zea mays
gccgccaccacttgctcgccttcgccccttctgtctcccttcgtccgtagcagaccaggaacgcccaaggcgctagcgtctccaagatggtgctgcaaaacgacattgacttactcaatccatcggcagagcttgagaagctaaagcacaagaagaagcggctagtccagtcccccaactccttcatcaacgaataaagtgccagggctgtttcagcataaccactgtgttcagccactcccagactgtggttgtgtgcccaggctgccaaactgttcttgcaacctaccggtgggaaggccaggctcacgaggggtgctcttccgt

SEQ ID NO: 450 - DNA, 252 bp, Zea mays
ctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgcaa

SEQ ID NO: 451 - DNA, 335 bp, Zea mays
  unsure (1)..(335): unsure at all n locations
gcagcgctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgncaaccccaggaggaaaggcaaggctcactgaggggtgctctttccgcagaagggagcctagagcggatgtggtctt

SEQ ID NO: 452 - DNA, 347 bp, Zea mays
cttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatga

SEQ ID NO: 453 - DNA, 259 bp, Zea mays
ttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactg

SEQ ID NO: 454 - DNA, 257 bp, Zea mays
cagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagatgttgttgtgtgcctggctgcca

SEQ ID NO: 455 - DNA, 280 bp, Zea mays
cagacttctgctgcagcgcctccgccgccgccgccgcatctaacgcagttccctccgccgcagcccgaggcaagatgggtctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccac

SEQ ID NO: 456 - DNA, 288 bp, Zea mays
ctccctgctcagactcgtctgctgcagctcctcctccgccgccgtatcaaacgcactctcctccgtcgtcgcccgaggcatgatggatctccagaacgacatcgaccttctgaacccgccggcagagctcgagaaactcaagcacaagaagaagcgcctcgtccaatcccccaactccttcttcatggatgtcaagtgccagggatgcttcagcataaccacgggtttcagccactcccagactgttgttgtgtgcccaggctgccaaactgttctctgccagcccac

SEQ ID NO: 457 - DNA, 257 bp, Zea mays
cagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgc

SEQ ID NO: 458 - DNA, 334 bp, Zea mays
accacttgctcgccttcgccccttctgtctcccttcgtccgtagcagaccaggaacgcccaaggcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccaggctcaccgaggggtgctccttccgtcgcaaggg

SEQ ID NO: 459 - DNA, 371 bp, Zea mays
  unsure (1)..(371): unsure at all n locations
ttatcgtcaacatcataatataaattcaaagagccattagttcatcacaatccaaaccaaaccagatataagtttggaagtagccaacatgcaacacatagctgctcgagaacaacttatggaaaatcttagctaaaggcagttcatgacgctagtatctggcatagagcaaaacttgaagaccacatccgctctagtctcccttcctgcggaaagagcagccctcagtgagccttgcctttcctcctgtgggttggcagaggacagtttggcagccagggcacacaacaacagtctggggctgaaaacagtggttatgctgaagcacccctggcacttaacatccatgaagaangantggggcactggac

SEQ ID NO: 460 - DNA, 432 bp, Zea mays
gatctgctcaacccgccggcagaactcgagaagctcaagcacaagaaaaagagactgggccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgata

SEQ ID NO: 461 - DNA, 398 bp, Zea mays
caagaaaaagagactcgtccagtcgcccaactccttcttcatggatgttaagtgccgggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgatatttggtg

SEQ ID NO: 462 - DNA, 442 bp, Zea mays
  unsure (1)..(442): unsure at all n locations
gccgccgtatcaaacgcactctcctccgccgtcgcccgaggcaagatggttctccagaacgacatcgaccttctgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagtggagtctgttattagtactggatcggttgtcaatctccagtatgtggattcaaattttgctctgtgcccagacgttaaggtcatgaactaccttagctaaggctntccgcatgtntgtctggtgctgctatgt

SEQ ID NO: 463 - DNA, 441 bp, Zea mays
agcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaa

SEQ ID NO: 464 - DNA, 455 bp, Zea mays
  unsure (1)..(455): unsure at all n locations
gctgcagcgcctccgccgccgccgccgcatctaacgcagttccctccgccgcagcccgaggcaagatggttctcgagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttggtctcgagcagctatgtgttgcatgttggctacttncaaacttatatc

SEQ ID NO: 465 - DNA, 434 bp, Zea mays
ccagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagctgagtctgttattagtactggatcggttgtcaatctccagtatgtggtcttcaagttttgctctgtgccccagacgttagggtcatgaacttccttagctaaggctttccgcatgttgttctgtgctgctatgtatcgcacgttggttcttgctgaacttatagcttgtttggttcgg

SEQ ID NO: 466 - DNA, 447 bp, Zea mays
gtccgcgcaaaaccctccctgctcagactcgtctgctgcagctcctgctccgccgccgtgtcaaacgcactctcctccgccgtcgcccgaggcaagatggttctccagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagctgagtctgttattagtactggatcggttgtcaatctccagtatgtggtcttcaagttttgctctgtgccccagacgttagggtcatg

SEQ ID NO: 467 - DNA, 448 bp, Zea mays
cggacgcgtgggtgcaaaacgacattgacttactcaatccaccggcagagcttgagaagctgaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaggccagggctcaccgaggggtgctccttccgtcgcaagggcgattaggtcctgcttctcttaacgtgagaagagataaatttggtgttttgcaactttctcaggatatgtactcggtgaggattttgttaattattatggctgttagcgtggcctgacaatgcttgtgtaaacctgcactttgtttgagcgtagtgacagctaatatggtgcttgttggcttttgctg

SEQ ID NO: 468 - DNA, 435 bp, Zea mays
cagactcctgctgcagcgcctccgccgcttttgtttcatctaacgcagttccctccgcgggagggtgaggcaagatggttctccagaacgacattgatctgctcaacccgccggcagaactcgagaagctcaagcacaagaaaaagagactcgttcagtcgcccaactccttcttcatggatgttaagtgccaggggtgcttcagcataaccactgttttcagccactcgcagactgttgttgtgtgccctggctgccaaactgtcctctgccaacccacacgaggaaaggcaaggctcactgatggctgttctttccgcaggaaaggagactagagcggatgtggtcttcaagttttgctctatgccagatactaagcgtatgaactgcctttagctaaaattttccataagttggtcttgaacagctatgtgt

SEQ ID NO: 469 - DNA, 458 bp, Zea mays
gctgcagcgcctccgtcgccgctgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgttctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctgg

SEQ ID NO: 470 - DNA, 353 bp, Zea mays
acgcactctcctccgccgccgcccgaggcaagatggttctccagaacgacatcgaccttgtgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagtggagtctgttattagtactggatcggttgtcaatctccagtatgtggattcaaattt

SEQ ID NO: 471 - DNA, 442 bp, Zea mays
ctgctgcagcgcctccgccgccgccgccgcatctaacgcagttccctccgccgcagggcgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagaattttcataaatggttctcgagcagctatgtgttgcatgttggctac

SEQ ID NO: 472 - DNA, 415 bp, Zea mays
ctcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgatatttggtg

SEQ ID NO: 473 - DNA, 407 bp, Zea mays
cagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacctacaggaggaaaggcaaggctcactgagggctgctctttccgcaggaagggagactagagcggatgtggtcttcaagttttgctctatgccagatactagcgtcatgaactgcctttagctaagattttc

SEQ ID NO: 474 - DNA, 304 bp, Zea mays
tactcgagaagctcaagcacaagaaaaagagactcgtccagtcgcccaactccttcttcatggatgttaagtgccaggggtgcttcagcataacgactgttttcagccactcccagactgttgttgtgtgccctggctgccaaactgtcctctgccaacccacatgaggaaaggcaaggctcactgagggctgctctttccgcaggaagggagactagaccggatgtggtcgtcaagttttgctctatgccacatactaacgtcatgaactgcctttagctaacattttccagaacttgttctc

SEQ ID NO: 475 - DNA, 235 bp, Zea mays
cgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctgaaagtgctgtgagaccacctat

SEQ ID NO: 476 - DNA, 265 bp, Zea mays
caccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctgaaagtgctgtgagaccacctatgaaa

SEQ ID NO: 477 - DNA, 253 bp, Zea mays
  unsure (1)..(253): unsure at all n locations
gaccgcaggantgcacaagatgccattcgcgatttggatggtaagaatggttggagggttgagctgtcaaccaaagatggtggtggccgtggccgagaccgtaatcgttctgatatgaagtgctatgagtctggtgatattggccactttgcacgtgaatgtcgcttacggattggttcgggagggctgggtagtggaaggcgtcgcagccgatgtcctagatatctcagccggagccgaagtcgcagccgga

SEQ ID NO: 478 - DNA, 268 bp, Zea mays
  unsure (1)..(268): unsure at all n locations
gacgactacgccgggtcntcttcagacccaggtcgttgccgcctacgccaggtgcccaaatcttcttagggcccttcgccggcgacgagcacacaagcttggttgacccccaacaaattgcnaaatgtcagccaatgtcggtgaatcaaccagcggtggcagcagcaatgatgcagctggggggagctttgaatgtaacanatgctttgagctgcctcaagagccaatagtgactctttgtggccaccncttctgctggccatgcntt

SEQ ID NO: 479 - DNA, 282 bp, Zea mays
gcgacgactacgccgggtcttcttcagacccaggtcgttgccgcctacgccaggtgcccaaatcttcttagggcccttcgccggcgacgagcacacaagcttggttgacccccaacaaattgcaaaatgtcagccaatgtcggtgatcaaccagcggtggcagcagcaatgatgcagctggggggagctttgaatgtaacatatgctttgagctgcctcaagagccaatagtgactctttgtggccactcttctgctggccatgctttaccggtggctgcac

SEQ ID NO: 480 - DNA, 255 bp, Zea mays
tctgaagatgacattcgtcaaattccaaaatacaaatttcggaagatggaagagcctgaaaagcagtctgttggtgtgcctggatcttctggtggaataatgatagaatgtggaaccaatcaacctattgaaaaagtacttgcagctgaagatgcggagtgctgcatttgcctctcagcttatgatgatggcgcagagctccgtgaactcccttgtggccaccattttcattgtgtttgcatcgataaatggctg

SEQ ID NO: 481 - DNA, 317 bp, Zea mays
cgaaggatgtgggaagacattttttgatgcaggggctcttaggaagcatgctcacgtccatggggagaggcaatatatctgtcactatgagaactgtggcaagaaattcttagatagttctaagttgaagagacattttcttattcatacaggagaaaagaattttgtgtgcccacatgaaggttgtgggaaggctttttcgttggattttaatttaaaggcacacatgaaaacacattctgcagataactatcatgtgtgccagtacccagaatgtggccgaagatttacacaagaatcaaaactaagagctcata

SEQ ID NO: 482 - DNA, 299 bp, Zea mays
atcttaaagagaaagataacggcagttctccagaatcttcaccattgaaagacaaaacaacagcagacgatgattcgtaccaatgtttgcttggttctgcaagcgatgtgcgtgatccaataactactccggtgtggttcttgttaatttctttgcctaaccagaaagaagatccacaactgcctcagttatcaaagagttacatgagaatcaaagaccgcagtttgcagatttcttctgtacagaggtacatcatgaagaagctggatctagctaatgaaaacgaggtggagatcatc

SEQ ID NO: 483 - DNA, 232 bp, Zea mays
cggctgctccgtctgcctccaggatttccaggtcggggagaaggtgcggacctgccggactgctggcacgtgttccacgtgccgtgcatcgacggctggctcatcaagcacggctcctgcccgctctgcaggaggaagctgtaggcggatcgaccggacgacgccatgaacgatgttcttctctgcgatcgagccgatgatgtgtgtgtgtgtgcccccgccgccaccacgg

SEQ ID NO: 484 - DNA, 251 bp, Zea mays
tgctcgattgtacatcggcaacctggatccccgggtgaccgctcgggagctggaggacgagttccgcacgttcggggttcttcgcagtgtctgggttgcccggaaaccacctggctttgcgtttattgattttgatgataagaaggacgcagaggatgcaatccggtgacctagatggcaagaatggatggagagttgagtaacctcgaaatgccaccgttggtcttgaagtccgtgaccggaatgttggg

SEQ ID NO: 485 - DNA, 158 bp, Zea mays
ggaggaagcagatcggagaaggtgatctgttgtaatggctcgattgtacatcggcaacctggatccccgggtgaccgctcgggagctggaggacgagttccgcacgttcggggttcttcgcagtgtctgggttgctcggaaaccacctggctttgcgt

SEQ ID NO: 486 - DNA, 291 bp, Zea mays
cgctcacctacatctccgtccgcaagcgtcaccaggctgccccgggaggccgggaggaagcagatcggagaaggtgatctgttgtaatggctcgattgtacatcggcaacctggatccccgggtgaccgctcgggagctggaggacgagttccgcacgttcggggttcttcgcagtgtctgggttgctcggaaaccacctggctttgcgtttattgattttgatgataagagggacgcagaggatgcaatccgtgacctagatggcaagaatggatggagagttgagttat

SEQ ID NO: 487 - DNA, 228 bp, Zea mays
ctacatctccgtccgcaagcgtcaccaggctgccccgggaggccgggaggaagcagatcggagaaggtgatctgttgtaatggctcgattgtacatcggcaacctggatccccgggtgaccgctcgggagctggaggacgagttccgcacgttcggggttcttcgcagtgtctgggttgctcggaaaccacctggctttgcgtttattgattttgatgataagaggga

SEQ ID NO: 488 - DNA, 271 bp, Zea mays
gcaatccgtgacctagatggcaagaatggatggagagttgagttatctcgtaatgccagcggtggtcgtggaggtcgtgaccggcatggtgggtctgagtccaagtgttacgagtgtggtgagactggccactttgctcgtgagtgccgtttgaggattggttctggaggtctaggcagcggaaggcgccgaagccgtagccgtagccgcagtcgcagtcccagatatcgccggagtccaagttacggtagaaggagttacagtcctgcag

SEQ ID NO: 489 - DNA, 232 bp, Zea mays
gggacgcagaggatgcaatccgtgacctagatggcaagaatggatggagagttgagttatctcgtaatgccagcggtggtcgtggaggtcgtgaccggcatggtgggtctgagtccaagtgttacgagtgtggtgagactggccactttgctcgtgagtgccgtttgaggattggttctggaggtctaggcagcggaaggcgccgaagccgtagccgtagccgcagtcgcag

SEQ ID NO: 490 - DNA, 292 bp, Zea mays
ggagattcggaatgcacttgaaatgattcaaaggggggaaaatgtaaggctcgagtctatcttctatggcggcctcgacattcatgacagacacagggacatgcgccttgacattgacaatatgtcctatgaggaactattagcacttgaggaaaggatcggaaatgttagcactggcctcagcgaggaagctgtgataaagttgctcaaacaaaggaaattttcatcgtggagactaaaagcatctttggacccagaaccatgctgtatttgccaggaggagtacgttgat

SEQ ID NO: 491 - DNA, 274 bp, Zea mays
cctgcacatgtccacgctgtgtaaaggcatttgatgaggatgcactacttgaggggttcaggtgcaagaaccaagcatgtgatggctttttgctgcccaactcaggtaaaaaggcttatacatgccaaaaatgtggtgcttctagagatgtggaagagataaaaaatatgagaagcgaaatactacagttatcggataaagcatcttcatttctttcatcaggaaataaggctgaagcaggttctatctacaagataatcgaacagttagagag

SEQ ID NO: 492 - DNA, 284 bp, Zea mays
cctgcacatgtccacgctgtgtaaagggttttgatgaggatgcactacttgaggggttcaggtgcaagaaccaagcatgtgatggctttttgctgcccaactcaggtaaaaaggcttatacatgccaaaatgtggtgcttctagagatgtggaagagataaaaaatatgagaagcgaaatactacagttatcggataaagcatcttcatttctttcatcaggaaataaggctgaagcaggttctatctacaagataatcgaacagttagagagaaatctgtacc

SEQ ID NO: 493 - DNA, 288 bp, Zea mays
cgagacttgggcaagcgagtcatgacaggtgatatctcgcccgacaggtttgtcaacatgtcggatgaggagctcaagagcgaggatcaacgcaagatggaaatcgagctggagaaggagaacatgaagaaggcccaggtaccaatggccgagaagagcatcagtgacagtctggaatgcggcaagtgtaagaagaagcgtgtcagctacacccaggcgcagacacgaagtgccgatgaaccgatgacgacattttgcgagtgtatgaactgcggtaatcgttggaag

SEQ ID NO: 494 - DNA, 268 bp, Zea mays
cgagacttgggcaagcgagtcatgacaggtgatatctcgcccgacaggtttgtcaacatgtcggatgaggagctcaagagcgaggatcaacgcaagatggaaatcgagctggagaaggagaacatgaagaaggcccaggtaccaatggccgagaagagcatcagtgacagtctggaatgcggcaagtgtcggaagaagggtgtcagctacacccaggcgcagacacgaagtgccgatgaaccgatgacgacattttgcgagtgtatga

SEQ ID NO: 495 - DNA, 280 bp, Zea mays
cttttattcttgatgatcctgcaggaaacagctttattgagaatccgcatgctccgttattagatcctttactatctgtgagattctacgaaagaactcgtgaacaacaagcagcacttggctttcttgctgaaccaccaaaagaacaacctggagaggctgtattgcctgcttcagcagtggaatccaattctgatgggttgcaaagcgtgccccatggctcagttggagctgttgcaggtcgtcgtgctatagctcagggaaaccctgatgaagttgc

SEQ ID NO: 496 - DNA, 229 bp, Zea mays
ttgagatctcttgggtcaggagaggctgcattcacttttattcttgatgatcctgcaggatacagctttattgagaatccgcatgctccgttattagatcctttactatctgtgagattctacgaaagaactcgtgaacaacaagcagcacttgggtttcttgctgaaccaccaaaagaacaacctggagaggctgtattgcctgcttcagcagtggaatccaattctg

SEQ ID NO: 497 - DNA, 428 bp, Zea mays
  unsure (1)..(428): unsure at all n locations
ctcttgggtcangagaggctgcattcacttttattcttgatgatcctgcaggaaacagctttattgagaatccgcatgctccgttattagatcctttactatctgtgagattctacgaaagaactcgtgaacaacaagcagcacttggttttcttgctgaaccaccaaaagaacaacctggagaggctgtattgcctgcttcagcagtggaatccaattctgatgggttgcaaagcgtgccccatggctcagttggagctgttgcaggtcgtcgtgctatagctcagggaaaccctgatgaagttgctgcagcattgtgtagatattcagcaccagaagaggttgatactttaccatcaacatgtggagcctgtggaacagaatgcgtcacacgtttctttgctacaaaaatcccatatttccgggag

SEQ ID NO: 498 - DNA, 411 bp, Zea mays
ggtcaggagaggctgcgttcacttttattcttgatgatcctgcaggaaacagcgttatggagaatccgcatgctccgttattagatcctttactatctgtgagattctacgaaagaactcgtgaacaacaagcagcacttggctttcttgctgaaccaccaaaagaacaacctggagaggctgtattgcctgcttcagcagtggaatccaattctgatgggttgcaaagtgtgccccatggctcagttggagctgttgcaggtcgtcgtgctatagctcagggaaaccctgatgaagttgctgcagcattgtgtagatattcagcaccagaagaggttgatactttaccatcaacatgtggagcctgtggaacaaaatgcgtcacacgtttctttgctacaaaaatcccat

SEQ ID NO: 499 - DNA, 436 bp, Zea mays
agaaaataaacctgtgtaggttttggctgcattggagaggattgaacagcaagcggaggtgacctatgatcaattgctaatgctggaggctaatctattttttggcgcctttgcctactatgatcggcatagagacatgcggatggatattgatgatatgtcctatgaggaattattggccctggacgagagaataggctctgtgagcacagctctttcagaggagcagttcacataatgcctcacaagaagcatatatcgtcaggtcgctctagaagtgaacacatcaaccgttgatgacatgaaatgcagcatctgtcaggaagagtacgcggagggcgaacaggcttggaggctgccatgcgagcaccggtaccatgtgtgctgcataggccaatggcttgggcagaagaactggtgtacagtatgcaaagcg

SEQ ID NO: 500 - DNA, 285 bp, Zea mays
caaatggataaatgtgagagcagggacctgctgcatatgctgtgagactccgattgactcccttctgtacagatgtgggcacatgtgcacttgctcgaaatgcgcaaacgaattggttcgaggtggagggaaatgcccgttgtgccgcgcacccataatcgaggtcatccgagcatacttcatcatgtagatacaaaaggaagacagcaagaagatagaagaggcccaaattgtttttggtctgtgtggagtcgttagcgggttgtgtattcaattttgttcatt

SEQ ID NO: 501 - DNA, 245 bp, Zea mays
aagcactcgggtcagaacccttggctctagggaatttatgcgctactatcgccagaaaccacggccttctgttgcaccagaccgtgcgcttgcactttcactagcttccagctacaagagcatgggtttggtgacagtgcagtctaaggagcagatggtgaggctgaaagttctccgtgctatgaacaggaccggggtcgagactatgcggaacaagatcggaatgaagagcaatgtgatccgga

SEQ ID NO: 502 - DNA, 375 bp, Zea mays
gaaaggcactcgggtcagaacccttggctctagggaatttatgcgctactatcgccagaaaccacggccttctgttgcaccagaccgtgcgcttgcactttcactagcttccagctacaagagcatgggtttggtgacagtgcagtctaaggagcagatggtgaggctgaaagttctccgtgctatgaacaggaccggggtcgagactatgcggaacaagatcggaatgaagagcaatgtgatccggaacctccctaagaattgcccgcactagacaacactgccttctcctgcaccctatctggagcttctcctggcatttatatggtgtcttatggtttcttgtctgtcgctgacaacgttggcgcttaagat

SEQ ID NO: 503 - DNA, 320 bp, Zea mays
  unsure (1)..(320): unsure at all n locations
ctccnactcgcctcgtctagaagaggaaggaagaacaaagataagcgactacgcgtcactcctcgccttcctcccgcctcgagctcttcccggagcaaccggagccacagacgtcaggacagcctagcgcgttccacgccggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgca

SEQ ID NO: 504 - DNA, 266 bp, Zea mays
cgcctagaagaggaaggaagaacagagataagcgacaacgcgtccctcctcgccttcctcccgcctcgagctcttcccggagcaaccggagccacagacgtcaggacagcctagcgcgttccacgccggtatgcagaaccagatcatgtgccatgcttgccggacccttctgctctacccgcgtggcgcgtccagcgtctgctgcgcggtttgccaggccatcaccaccgtgccgccaccaggattggagatggctcagcttataa

SEQ ID NO: 505 - DNA, 264 bp, Zea mays
cccgcctcgagctcttcccggagcaaccggagccacagacgtcaggacagcctagcgcgttccacgccggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaagtgttc

SEQ ID NO: 506 - DNA, 281 bp, Zea mays
cgcctagaagaggaaggaagaacagagataagcgacaacgcgtccctcctcgccttcctcccgcctcgagctcttcccggagcaaccggagccacagacgtcaggacagcctagcgcgttccacgccggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaa

SEQ ID NO: 507 - DNA, 161 bp, Zea mays
gctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaaggtgttcatgttgca

SEQ ID NO: 508 - DNA, 293 bp, Zea mays
gcctagaagaggaaggaagaacagagataagcgacaacgcgtccctcctcgccttcctcccgcctcgagctcttcccggagcaaccggagccacagacgtcaggacagcctagcgcgttccacgcggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtat

SEQ ID NO: 509 - DNA, 274 bp, Zea mays
ccctcgcctcgcctagaagaggaaggaagaacagagataagcgacaacgcgtccctcctcgccttcctcccgcctcgagctcttcccggagcaaccggagccacagacgtcaggacagcctagcgcgttccacgccggtatgcagaaccagatcatgtgccatgttttccggacccttctgctctacccgcgtggcgcgtccagcgtctgctgcgcggtttgccaggccatcaccaccgtgccgccaccaggattggagatggctcagcttata

SEQ ID NO: 510 - DNA, 287 bp, Zea mays
attgagatagtgcttgcagctgaagatgcagagtgttgtatttgcctatctgcttatgatgatggtgcagagttgcgggaactcccttgtgggcaccatttccactgcacctgcatcgataagtggcttcacatcaatgcaacatgccccctgtgcaagtacaacattcggataacaacagtagcagtggaagtgaagaagtatgaatgcaaccgcttgacaatgccaatctgtgtaaacttcgtgcctgtgtcgttgctaatgcaactccagggcttgagcagtgt

SEQ ID NO: 511 - DNA, 359 bp, Zea mays
gatgacttcaaggagagactatccaagcttctgagtttacaagaagcctggactctaataattgatgatggattggcggcttcatttgtggccccggctactgattcgttagaagatgacagccaactaaccattgaagagtatcagaggagttgggagcagaacgaggaacttggtctgaatgacatggatacgtgctctgcagactcggcttacaacacgaccaacacataattattttagttttgatgtgccgaatgtatttgttacgctatcagtttactttgatgaactttcagtgtgtatactaatatcaacaacttatatttcctctgacgataaacaaaagatgaaataaa

SEQ ID NO: 512 - DNA, 265 bp, Zea mays
ggacatgttatcgatgaacatagcgatatgcgtttagatgtggataacatgacttatgaggaacttgtagcattgcaagagcagataggcgatgtcaatactggtttgacagaaagctatatccaggaaaacttgaggtccagttttcatgttccaggagcagctagcatgtctgatcagttttctgagctttctttggagaatgatgcttgcataatatgccaggaggagtataaagctaaagaacttataggaacccttgaat

SEQ ID NO: 513 - DNA, 345 bp, Zea mays
ctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcattga

SEQ ID NO: 514 - DNA, 280 bp, Zea mays
cagaggctctgtttctggctaggcaagctgctttggcggaggggagcaagcctgctagcaccccaatgctttacagctgtgctctttgtggaaaggagtacagaagctcgaaagctcacgagcagcatcttaactcgcgatcacatcttttgaaagcctctcaggagcccaatgcctctattgctggtatcacgatagtcaagccacttcctgaacgagtctcacgaagagctccatctgcagtagaggaggatcaagacgacgatgaggaagaagagtg

SEQ ID NO: 515 - DNA, 399 bp, Zea mays
  unsure (1)..(399): unsure at all n locations
ggtggctggagttcctggtgtcacagaggctctgtttctggctaggcaagctgctttggcggaggggagcaagcctgctagcaccccaatgctttacagctgtgctctttgtggaaaggagtacagaagctcgaaagctcacgagcagcatcttaactcgcgatcacatcttttgaaagcctctcaggagcccaatgcctctattgctggtatcacgatagtcaagccacttcctgaacgagtctcacgaagagctccatctgcagtagaggaggatcaagacgacgatgaggaagaagagtgggttgaagttgacccaagtgagatggagttggctgatgagtctacttcaaacatgcangaagatgagcactcctcaaaatcagatgatgacatgga

SEQ ID NO: 516 - DNA, 274 bp, Zea mays
ccgagctgcgtgcgtcgtcagataaggcagccgccggcacggcaatgccggttccgcttgctccgtacccagctcctccggcgccattcacgccgcccagtggggcccagagccagctcgtctgcaccgggtgccggaacctcctcatgtacccagctggtgcgacgtcggtctgctgcgccgtctgcagcaccgtcaccgccgtgccggctccaggaactgagatggcgcactagtgtgcggaggatgccacaccctcctcatgtacatacgc

SEQ ID NO: 517 - DNA, 423 bp, Zea mays
tgttcttatgcatgcagcagccataagcattgctactagcgtctcctgcacgtgctgtgtcgtttccagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgccgaggatgccaaaccctcctcaggtacatacgcggcgcgacgagcgtgc

SEQ ID NO: 518 - DNA, 438 bp, Zea mays
agagagagaggggaagagagagagagagagagagagatagatgtggtaactcaggaactgttcttatgcatgcagcagccataagcattgctactagggtttcatgcggggcgaagcagttggtctctgccgcctgaacgccgccggaatctgcgaggcctccccgagctgcgtccgtcgtcagataaggcagccgccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccggcgtgccggctccaggaactgagatggcgcagctagtgtgcggaagatgccacacccttctcatgtacatacgc

SEQ ID NO: 519 - DNA, 418 bp, Zea mays
ggtaactcaagaactgttcttatgcatgcagcagccataagcattgctactagcgtcgcctgcacgtgctgtgtcgtttccagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacacccttctcatgtacata

SEQ ID NO: 520 - DNA, 450 bp, Zea mays
atggatcagccatttatggctgctatcaatagccagcctttcgtggaggatattgagccagggaagaaagccagtggggacatgcctgcgacaacaggaagcggatgcttcgaatgcaacatctgccttgattttgcatcagaaccagtggttactttctgtggtcatctctactgctggccttgtatctacgagtggctgcgccctggggtggagtcagctgccagcgacaacagcagttcggcaaggcggcaatgtcctgtatgcaaggcaacactctcaacggacacccttgtgccactatacggccgtggaggcaactcaaagaagtcacttgatggcatggccatcccgcgccgtcccatggtacaccgggagactgttgaggagcaacagaatgcacagagcaatgtcaatgaccagcactaccaccagagcatggaagacaac

SEQ ID NO: 521 - DNA, 248 bp, Zea mays
atctgcctaactgaatatgaggatggagaccagatacgaattcttccttgcaagcacgagttccacctgcaatgtgttgacaaatggctgaaagaaatacacagggtgtgccctctgtgccgcggagacgtctgcgaagtcgcctcgtgaagaccttggcgctgccatcccttcctcacggcaccggcagatagcgcatcccccgcctgctccgttgttgaagctggtttggtcaggcaacggcgatc

SEQ ID NO: 522 - DNA, 428 bp, Zea mays
agagctacaaaaagctagaggcaccccaacgcagtgatgatatggaacagtgccatatctgcctaactgaatatgaggatggagaccagatacgaattcttccttgcaagcacgagttccacctgcaatgtgttgacaaatggctgaaagaaatacacagggtgtgccctctgtgccgcggagacgtctgcgaagtcgcctcgtgaagaccttggcgctgccatccctttcctcacggcaccggcagatagcgcatcccccgcctgctccgttgttgaagctggtttggtcaggcaacggcgatcacgtcccgtcaatctgggcgtccctgccgaagagcgtggccagatcctgcgaccaatgcgtcgctgttcctgccatcaactttttaagataccgagactgtatatagctcttgtagcctctcc

SEQ ID NO: 523 - DNA, 239 bp, Zea mays
gcacgagggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagagga

SEQ ID NO: 524 - DNA, 259 bp, Zea mays
gcacgaggttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaag

SEQ ID NO: 525 - DNA, 299 bp, Zea mays
cacacagttcccatataggcagccatcggctacacagcctcgcctccgtaagcagagtgtgtcgttgcggaggcaggaagagagacgacggcagccatggcgacctccttccaggggacgaccaccaagtgcaccgcctgcgacaagactgtgtaccttgtggacaagctcaccgccgacaaccgcatctaccacaaggcctgcttccgcagccaccactgcaagggcaccctcaagctcgccaactacaactccttcgagggagtgctctactgcaggcctcacttcgaccagctgtt

SEQ ID NO: 526 - DNA, 328 bp, Zea mays
ggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactccgaaggttgtcaagccagaaagaaacgttgggaatgagaatgctactaaagtctcaagcgcct

SEQ ID NO: 527 - DNA, 231 bp, Zea mays
cggacgcgtggagagtgtgtcgttggaagagagacgacggcggccatggcgacctccttccaggggccgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcct

SEQ ID NO: 528 - DNA, 240 bp, Zea mays
gttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacaggg

SEQ ID NO: 529 - DNA, 258 bp, Zea mays
gtcgtagcagaggcaggaagagacacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttg

SEQ ID NO: 530 - DNA, 240 bp, Zea mays
ggacctggcggccatggcgacctccttccaggggacgaccaccaagtgcaccgcctgcgacacgacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaa

SEQ ID NO: 531 - DNA, 237 bp, Zea mays
cacagttcccatataggcagccatcggctacacagcctcgcctccgtaagcagagtgtgtcgttggaagagagacgacggcggccatggcgacctccttccaggggacgaccaccaagtgcaccgcctgcgacaagacggtgtaccttgtggacaagctcaccgccgacaaccgcatctaccacaaggcctgcatccgctgccaccactgcaagggcaccctcaagctcgccaacta

SEQ ID NO: 532 - DNA, 229 bp, Zea mays
gtgtgtcgttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccag

SEQ ID NO: 533 - DNA, 331 bp, Zea mays
cgtatcccgcagtacggccgaatccgggtcgaccacgaccgcacgagccgcgaccgtggcgacgtggtcaggacgcgtggggagacgacggcggccatggcgacctccttccaggggacgaccaccacgtgcaccgccagcgacaagacggtgtaccttgtggacaagctcaccgccgacaaccgcatctaccacaaggcctgcttccgctgccaccactgcagaggcaccctcaagctcgccaactacaactccttcgatggagtgctctactgcaggcctcacttcgaccagctgttcaagaggacagggagcttggacaagagcttcg

SEQ ID NO: 534 - DNA, 284 bp, Zea mays
cggacgctggtgcctacctagcggtatcaatacccggctgcagctcaccaccaccaccaaccaaccaacacacccacagttcccatataggcagccatcggctacacagcctcgcctccgtaagcagagtgtgtcgttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctg

SEQ ID NO: 535 - DNA, 264 bp, Zea mays
cggacggtggggtcgttggaagagagacgacggcggccatggcgacctccttccaggggacgaccaccaagtgacaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggac

SEQ ID NO: 536 - DNA, 267 bp, Zea mays
  unsure (1)..(267): unsure at all n locations
gtncgttggaagagagacgacggcggccatggcgacctccttccaggggacgagcaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagttcgaanag

SEQ ID NO: 537 - DNA, 268 bp, Zea mays
cccatataggcagccatcggctacacagcctcgcctccgtaagcagagtgtgtcgttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgca

SEQ ID NO: 538 - DNA, 252 bp, Zea mays
cgttgcggaggcaggaagacagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttccgacagctgttcaagaggacagggag

SEQ ID NO: 539 - DNA, 281 bp, Zea mays
gttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactccgaaggttgtcaa

SEQ ID NO: 540 - DNA, 260 bp, Zea mays
ggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtca

SEQ ID NO: 541 - DNA, 297 bp, Zea mays
gaggtcgttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaag

SEQ ID NO: 542 - DNA, 272 bp, Zea mays
ctcgagccgttgcggaggcaggaagagagacgacggcggccatggcgacctccttccaagggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttgcgacagctgttcaagaggacagggagcttggacaagagc

SEQ ID NO: 543 - DNA, 269 bp, Zea mays
tacccggcgcagctcaccaccaccaccaaccaaccaacccacagttcccatataggcagccatcggctacacagcctcgcctccgtaagcagagtgtgtcgttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcg

SEQ ID NO: 544 - DNA, 310 bp, Zea mays
tgtcgttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactccgaaggttgtcaagccagaaagaaacgttgggaatgag

SEQ ID NO: 545 - DNA, 267 bp, Zea mays
gtcgttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagc

SEQ ID NO: 546 - DNA, 244 bp, Zea mays
atcgttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacaggga

SEQ ID NO: 547 - DNA, 200 bp, Zea mays
cacaagagcttcgaaggaactcccaaggttgtcaagccagaaagaaacgttgggaatgagaatgctactaaagtctcaagcgcctttgctggcaccagagagaaatgtgttggatgcagcaagacagtctatccaactgagagggtcactgttaacaacactagtaccacaagagctgcttcaagtgctgccatggaggg

SEQ ID NO: 548 - DNA, 234 bp, Zea mays
gttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctg

SEQ ID NO: 549 - DNA, 336 bp, Zea mays
  unsure (1)..(336): unsure at all n locations
gcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaagccagaaagaaacgttgggaatgagaatctactanagctcaagcgcttt

SEQ ID NO: 550 - DNA, 339 bp, Zea mays
agtgcggaggcaggaagagagacgacggcggccatggcgacctccttccaggggacgaccaccaagtgcaccgcctgcgacaagactgtgtatcttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccacgggtgtctagccagatagatacgttgggaatgagaatgctactacagtctcaagcgcc

SEQ ID NO: 551 - DNA, 266 bp, Zea mays
caggaagagagacgacggcggccatggcgacctccttccaggggacgaccaccaagtgcaccgactgcgacaagactgtgtaccttgtggacaagctcaccgccgacaaccgcatctaccacaaggcctgcttccgctgccaccactgcaagggcaccctcaagctcgccaactacaactccttcgaaggagtgctctactgcaggcctcacttcgaccagctgttcaagaggacagggagcttggacaagagcttcgaaggaact

SEQ ID NO: 552 - DNA, 410 bp, Zea mays
  unsure (1)..(410): unsure at all n locations
gtcgttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctcaagctcgccaactacaactccttcgagggagtgctctactgcangcctcacttcgaccagctgttcaagaggacagggagcttggacaagagcttcgaaggaactcccaaggttgtcaagccagaaagaaacgttgggaatgagaatgctactaaagtctcaagcgcctttgctggcaccagagagaaatgtgttggatgcagcaagacagtctatccaactgagaaggtcactgt

SEQ ID NO: 553 - DNA, 424 bp, Zea mays
  unsure (1)..(424): unsure at all n locations
gcacagcctcgcctccgtaagcagagtgtgtcgttgcggaggcaggaagagagacgacggcggccatggggacgtccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaagccagaaagaaacgttgggaatgagaatgctactaaagtctcaagcgcctntgctggcaccagagagaaatgtgttggatgcagcaagacagtctatcccac

SEQ ID NO: 554 - DNA, 447 bp, Zea mays
  unsure (1)..(447): unsure at all n locations
cacagttcccatataggcagccatcggctacacagcctcgcctccgtaagcagagtgtgtcgttgcggaggcaggaagagagacgacggcggccatggcgacctccttccaggggacgaccaccaagtgcaccgtctgcgacaagacggtgtaccttgtggacaagctcaccgncgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactcccaaggttgtcaagccagaaagaaacgttgggaatgagaatgctactaaagtctcaagcgcctttgctggcaccagagagaaatgtgttggatgcagcangacagtcta

SEQ ID NO: 555 - DNA, 379 bp, Zea mays
tctcagttggatagactgtcttgcgtgagagggtcactgttaataacactatgtgccagaagagctgtttgaagtgctgccatggagggtgcaccatcagcccttctaactacagcttcccctcgtgcgcaatgtagttagaagggctggtggtgcaagcaccaccacatccagctgatcaaggagaaggggaacttcagccagcttgagaatgaccacgagaagacatcacaggctgggtcactggaggacgatgaacaagagtattgatcactgagcacaaccacagatgaataatgaatcctcttgcatttgcctagagcactatgtatttctgtggcgtggttcgatttcagttttaccaatggaggtcatgtgt

SEQ ID NO: 556 - DNA, 245 bp, Zea mays
caccccgctgccgcggctcgaacataaaccctagagccgccggcccggtcgcgctacgacacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcga

SEQ ID NO: 557 - DNA, 312 bp, Zea mays
ccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggacgtttggggttctgaggagtgtatgggttgctaggaaaccaccagggtttgccttcattgactttgatgaccgcaggatgcacaagatgccattcgtgaattggatggtaagaatggttggaggg

SEQ ID NO: 558 - DNA, 296 bp, Zea mays
agctccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggacgtttggggttctgaggagtgtatgggttgctaggaaaccaccagggtttgccttcattgactttgatgaccgcaggagtgcacaagatgccattcgtgaattgg

SEQ ID NO: 559 - DNA, 230 bp, Zea mays
gagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcaggatgcacaagatgccattcgcgatttggatggtaagaatggttggagggttgagc

SEQ ID NO: 560 - DNA, 277 bp, Zea mays
ctcaaatcagcgggagggaactcgcacgcgaaggctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcaggatgcacaagatgccattcgtgaattggatggtaagaatggttggagggttgagctgtcaactaaagttggtggtggccgtggccgaga

SEQ ID NO: 561 - DNA, 356 bp, Zea mays
cctcactctactctggacgcgactcgaacttaaaccctagagccgcagccccggtcgctccaccgaccccaaatctcaaatcagcgggagggaactcgcacgcgaaggcaaatacgctttagatcccccattgcttctggctactaggccagcgcgcctcgattttcttctccgttttggtctaattcgctgaactcatggctcgcgtctacgttgggaacctggatccgcgtgtcacggcgcgggagatcgaggacgagttccggatgtttggggttctgaggagtgtatgggttgctaggaaaccaccagggtttgccttcattgactttgatgaccgcaggatgcacaagatg

SEQ ID NO: 562 - DNA, 250 bp, Zea mays
cgcaccccggtcgctccaccgaccccaaacctcaaatcagcgggagggaactcgcacgcgaaggcaaatacgctttagatcccccattgcttctggctactaggccagcgcgcctcgattttcttctccgttttggtctaattcgctgaactcatggctcgcgtctacgttgggaaactggatccgcgtgtcacggcgcgggagatcgaggacgagttccggatgtttggggttctgaggagtgtatggg

SEQ ID NO: 563 - DNA, 230 bp, Zea mays
cgaacataaaccctagagccgccggcccggtcgcgctagcgcacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatga

SEQ ID NO: 564 - DNA, 265 bp, Zea mays
caaatctcaaatcacccggagagaactcgctcgcgaaggctgaactcatggctcgcgtcttcgttgggaacctggatccgcgtgtcacgacgcgggagattgaggacgagttccgcacgtttggggttctgaagagtgtatgggttgctaggaaaccaccagggtttgccttcattgacttcgatgaccgcaggatgcacaagatgccattcgcgatttggatggtaagaatggttggagggttatctgtaaccaaaatggtggt

SEQ ID NO: 565 - DNA, 285 bp, Zea mays
aaaccctagagccgccggcccggtcgcgctaggcacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcaggatgcacaagatgccattcgcgatttggatggtaagaatggttggacggttgagctg

SEQ ID NO: 566 - DNA, 128 bp, Zea mays
ctcaaatcacccggagagaactcgctcgcgaaggctgaactcatggctcgcgtcttcgttgggaacctggatccgcgtgtcacggcgcgggagattgaggacgagttccgcacgtttggggttctgaa

SEQ ID NO: 567 - DNA, 275 bp, Zea mays
cgcgactcgaactcaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggcgatcgaggacgagttccggatgtttggggttctgaggagtgtatgggttgctaggaaaccaccagggtttgccttcattgactttgatgaccgcaggatgcacaagatgccatcgtgaattggatg

SEQ ID NO: 568 - DNA, 281 bp, Zea mays
gcaccccgctgccgcggctcgaacataaaccctagagccgccggcccggtcgcgctagcgcacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcaggatgcacaagatgccattcgcgattt

SEQ ID NO: 569 - DNA, 268 bp, Zea mays
gcaccccgctgccgcggctcgaacataaaccctagagccgccggcccggtcgcgtagcgcacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcaggatgcacaagatgc

SEQ ID NO: 570 - DNA, 292 bp, Zea mays
cgaacataaaccctagagccgccggcccggtcgcgtacgcacaaatctcaaatcacccggagagaactcgctcgcgaaggctgaactcatggctcgcgtcttcgttgggaacctggatccgcgtgtcacggcgcgggagattgaggacgagttccgacgtttggggttctgaagagtgtatggttctagaaaccaccagggtttgccttcattgacttcgatgaccgcgggatgcacaagattgccattcgcgatttggatggtaagaatggttggagggttgagctgtcaa

SEQ ID NO: 571 - DNA, 280 bp, Zea mays
aaacacttcccagccctccacgcaccccgctgccgcggctcgaacataaaccctagagccgccggcccggtcgcgctagcgcacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcaggatg

SEQ ID NO: 572 - DNA, 284 bp, Zea mays
tagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggatgtttggggttctgcagagtgtatgggttgctaggaaaccaccagggtttgccttcattgactttgatgaccgcaggatgcacaagatgccattcgtgaattggatggtaagaatggttgagggttgagctgtca

SEQ ID NO: 573 - DNA, 307 bp, Zea mays
gagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcaggatgcacaagatgccattcgcgatttggatggtaagaatggttggagggttgagctgtcaaccaaagatggtggtggccgtggccgagaccgtaatggttctgatatgaagtgctatgagtgtggtgaagtt

SEQ ID NO: 574 - DNA, 246 bp, Zea mays
agctccctcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggacgtttggggttctgaggagtgtatgggttgctaggaaaccacagggtttgccttc

SEQ ID NO: 575 - DNA, 275 bp, Zea mays
cccgcgcgcgtacgtatcctagttcggctcgagagcatcatcactctactctggacgcgactcgaacttaaaccctagagccgcagccccggtcgctccaccgaccccaaatctcaaatcagcgggagggaactcgcacgcgaaggctgaactcatggctcgcgtctacgttgggaacctggatccgcgtgtcacggcgcgggagatcgaggacgagttccggacgattggggttctgaggagtgtatgggctgctaggataccaccatggtttg

SEQ ID NO: 576 - DNA, 251 bp, Zea mays
  unsure (1)..(251): unsure at all n locations
aaacacttcccagccctccacgcaccccgctgccacggctcgaacatatancctagagccgccggcccggtcgcgctagcgacacaaatctcaaatcacccggagagaactcgctcgcgaaggctgaactcatggctcgcgtcttcgttgggaacctggatccgcgtgtcacatcgcgggagattgaggacgagttccgcacgtttgggcgttagaagagtgtatgggttgctaggaaaccaccagggttt

SEQ ID NO: 577 - DNA, 387 bp, Zea mays
acacgcaccccgctgccgcggctcgaacataaaccctagagccgccggcccggtcgcgctagcgacacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcagggatgcacaagatgccattcgcgatttggatggtaagaatggttggagggttgagctgtcaaccaaagatggtggtggccgtggccgagaccgtaatggttctgatatgaagtgctatgagtgtggt

SEQ ID NO: 578 - DNA, 321 bp, Zea mays
acgcacaccagtttcaagcagtcactacgccgtggcaacgtcgtgggaaggattcgagtcaggggcgaactacggtgacggcgctgtcaatacatgccgtagctgcgcgacgcgggctggcttgtccgatcggtttgcctcggccatgtcgactgagaaagttctttgcaagttcttcatgcatggagcttgcttgaaaggagagtactgtgaattctcccacgactggagtgatcaagcaaatagtgtttgcacattctaccaaaaaggtgcatgctcgtatggtagccgttgcagatatgaccatgtcagagtttctcg

SEQ ID NO: 579 - DNA, 219 bp, Zea mays
cctcaatatggaactccacatacagccaccccggccgcaccttcgtccacttatgacaaccaggtctgtcctatctgtcttgtgaaccccaaagacatggcgtttggctgtggacaccagacctgctgtgactgcggacagagtctcgagtcgtgtccaatctgtcgcactcccatcaccacaagaataaagctatactagcaagtggtggctttggat

SEQ ID NO: 580 - DNA, 189 bp, Zea mays
cctcaatatggaactccacatacagccaccccggccgcaccttcgtccacttatgacaaccaggtctgtcctatctgtcttgtgaaccccaaagacatggcgtttggctgtggacaccagacctgctgtgactgcggacagagtctcgagtcgtgtccaatctgtcgcactcccatcaacacaagaata

SEQ ID NO: 581 - DNA, 240 bp, Zea mays
ccaggtctgtcctatctgccttgtgaaccccaaagacatggcgtttggctgtggacaccagacctgctgtgactgcggacagagtctcgagtcgtgtccaatctgtcgcactcccatcaccacaagaataaagctatactagcaagtggtggctttggatcattgccaatgggtggtatactggagccacctgcctcacactggaggatcgccacagcatgtcccagtaaccgtcgggac

SEQ ID NO: 582 - DNA, 264 bp, Zea mays
  unsure (1)..(264): unsure at all n locations
tctaggtctgtcctatctgcctcgtgaaccccaaggacatggcgtttggttgtggacaccagacctgctgtgactgcggacagatcctggagtcgtgcccaatctgtcgcactcccatcaccacaaggatanagctatactagcaagtagtggtttggatcattgtcaatgggtggtatactggaggagccacccagcgtcacactggaggatcgtgtcagcatgcccatagatcgattgcaatcggaaagctggagcngcact

SEQ ID NO: 583 - DNA, 274 bp, Zea mays
catacagccaccccggccgcaccttcgtccacttatgacaaccaggtctgtcctatctgccttgtgaaccccaaagacatggcgtttggctgtggacaccagacctgctgtgactgcggacagagtctcgagtcgtgtccaatctgtcgcactcccatcaccacaagaataaagctatactagcaagtggtggctttggatcattgccaatgggtggtatactggagccaccctgcctcacactggaggatcgcgacggcatgtcccagtaacc

SEQ ID NO: 584 - DNA, 280 bp, Zea mays
aactccacctacagccacctcctctgcgtcttcagccacttatgacaaccaggtctgtcctatctgcctcgtgaaccccaaggacatggcgtttggttgtggacaccagacctgctgtgactgcggacagatcctggagtcgtgcccaatctgtcgcactcccatcaccacaaggataaagctatactagcaagtagtggtttggatcattgtcaatgggtggtatactggaggagccacccagcgtcacactggaggatcgtgtcagcatgcccataga

SEQ ID NO: 585 - DNA, 318 bp, Zea mays
ggaagagataaaaaatatgagaagcaaaatactacagttatcggataaagcatcttcatttctttcatcaggaaataaggctgaagcaggttctatctacaagataatcaaacagttagagagaaatctgtaccatgctttctcaactactttgctgcacacgtgcgaaacactattgaagatatatctggaattacaagattggtggactgcgttgacatactgtagattgacaattcctgtttatgaaagagtttatccaccttttcatccgatgattggattacaattctatacttgtggaaagcttgaatggga

SEQ ID NO: 586 - DNA, 265 bp, Zea mays
attcagatgtgtgtgtattcagtttacagagctcaatatgttacatcgaccttcccaacccgccggcagagcttaagaagctcaagcacaagaagtgcctcgtccagtccccccaactccttcatggatgtcaagtgccaacgatgcttcagcatgtccaattcgcttgtggcataggaatctcatcctagaaggactagaggggctgcaatgccggcatcgccatagctggaaatcgagcactgacggacaccgggcgccgaga

SEQ ID NO: 587 - DNA, 271 bp, Zea mays
attcagatgtgtgtgtattcagtttacagagctcaatatgttacatcgaccttcccaacccgccggcagagcttaagaagctcaagcacaagaagtgcctcgtccagtccccccaactccttcatggatgtcaagtgccaacgatgcttcagcatgtccaattcgcttgtggcataggaatctcatcctagattcaatagaggggctgcaatgccggcatcgccatagctggaaatcgagcactgacggacaccgggcgccgagatgggcc

SEQ ID NO: 588 - DNA, 172 bp, Zea mays
  unsure (1)..(172): unsure at all n locations
aagagattggtacaatgcaatgtgaacatcagtaccatgtgcgctgcattcacgaatggcttaagcagaagaattggtgtccaatatgcaaagcttcagctataccttcagagatgaccaagggagacgcatgaatcttggcgcanacttgtanatagcgtggatttattat

SEQ ID NO: 589 - DNA, 258 bp, Zea mays
attttgcaagctgttttatctgcaatcagcaaaggcatttgagcaagaactgccctgaaaacaaacatggcatctatccaaagggtggttgttgtaaggtatgtggcgaagttacccacttggccagacattgtccgaataaagggagacaagatttgatatcctccagagatgatgatgtcaacatggaagagcacagtcaggaatgtcctgcggttcaccatggtggagatgacctagaagatgatttcgttaatg

SEQ ID NO: 590 - DNA, 266 bp, Zea mays
attttgcaagctgttttatctgcaatcagcaagggcatttgagcaagaactgccctgaaaacaaacatggcatctatccaaagggtggttgttgtaaggtatgtggcgaagttacccacttggccagacattgtccgaataaagggagacaagatttgatatcctccagagatgatgatgtcaacatggaagagcacagtcaggaatgtcctgcggttcaccatggtagagatgacctagaagatgatttcgttaatgcagaagaa

SEQ ID NO: 591 - DNA, 296 bp, Zea mays
gctgttgcttctcacgctgggcaagagcagacgatgagaagcctcagttctcgtgaccttgggcccagtgcggcacgagcttcagctctcggctcccctctaagcacatcatggtctaagtggggatctccttcaggggtaccagattggggcgtagatggtgaagaattgggtaagctccgccgctcatcgtcgttcgagctcaggtctggcggcgatgaccctgatctctcctgggtgcatacactggtcaaggaatctccgccagagaagcaagttactaggtccgaatcaat

SEQ ID NO: 592 - DNA, 293 bp, Zea mays
caatgagctcccacctagccgctgctcttgtccagcgggagaagcagcagcagacaatgagaagtctcagctctcgtgaccttgggcctagtgcggcgcgagcatcggctcttggctcccctctaagctcatcatggtctaagtggggatctccttcggggacaccagattggggcataaatggtgaagaattgggtaagctccggcgctcatcgtccttcgagctgaggtctggtggtgacgaccctgatctctcttgggtgcatacactggtcaaggaatctccaccggag

SEQ ID NO: 593 - DNA, 259 bp, Zea mays
cgttctctccttcctatcggctccacacctccacgcaactggaagcttcgcttcaatctgccctactcctccgccgcctccaacaccgcagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgttt

SEQ ID NO: 594 - DNA, 277 bp, Zea mays
cgcaactggaagcttcgctgcaatctgccctactcctcttccgccgcctccaacaccgcagacgcagctgccgcgggcgggagcttggacgtgctacgctgctctcatctcgtttccgcgcaggaattgttctcaatggcccgcgtgtatgttggcaacttggattcacgggtgacttctggggaactcgaagatgagtaccgcgtgtttggagttctgcgaagtgtttggattgcacgtataccacctggctttgcatttaaagattttgacgaca

SEQ ID NO: 595 - DNA, 456 bp, Zea mays
tatcgggtccacacctcgacgcaactggaagcttcgcttcaatctgccctactcctccgccgcctccagcaccggagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcc

SEQ ID NO: 596 - DNA, 242 bp, Zea mays
attgagatttttgaggctagcaaagatgataacagagaggcttcaccagaatgctctatttgccttgatggattttacgacggagatgagctgataaggttgcactgtggccacaggttccactcaacatgcttggagccatgggtgaggaaatgttcagactgcccatactgtcggacaaatatacggtcacgatcctgatggcaaacccttagttctgaacaaattataaccaccgcgaa

SEQ ID NO: 597 - DNA, 228 bp, Zea mays
caaccggaggcacaaggtgtgcgaggcgcactccaaggcccccgtcgtgctcgtcgccggcctccgccagcgcttctgccagcaatgcagccggttccacgagctgtcggagttcgacgacgtcaagcgcactgccgcctgcgtctggccggccacaacgagcggcgccggaagagctcggccgacgcgcacgccggcggctgcaataatggattccgccaacacgcc

SEQ ID NO: 598 - DNA, 156 bp, Zea mays
gcacgaggtcgacgcggctctcaaggaggttcgccataggaagtaccatgtgatcagcacgcagactgatacttacaagaaaaaggtgaagcactcgcacgaggcgtacaagaacctgcagcaggagctaggcatgcgggaggacccggcgttcgg

SEQ ID NO: 599 - DNA, 260 bp, Zea mays
gcacgagagaacacctactcaagtagcaagtcatgctcaaaagtattttatacgccaatcaaatatgagcagaaggaagagaaggtctagccttttcgacatggttcctgatgagtccatggaccttccgccccttcctggaagtcaagaaccagagacctcaatgttaaatcaaccgccactgcctcctgctgtggaggaggaggtggaatcgatggagtcagatacttctgctgtcgcagagagttctggagcttctg

SEQ ID NO: 600 - DNA, 243 bp, Zea mays
gcacgagggacaaccggcagctgcggcggcgcaactcgctgctgctgtcggagctggcgcacatgaagaagctctacaacgacatcatctacttcctgcagaaccacgtggccccggtgacgagcccctcgtcggcggcgcacgcgtccctgcccagcgccggcggcggcggcgccgcggcgtcctcctgcaggctaatggagctggacccggcggactccccatccccgccgcggcggccgg

SEQ ID NO: 601 - DNA, 264 bp, Zea mays
aggcacacagccgccgtttcttttacttgcgctcggcacgcaggcgacggctgcggcgctcaggttggggttctcatcgacggcgtcacggcttcccctcccgcctctcgccagtcgcttcgcgccctcgcctccggtcctccgcacactggccggtgaccctgcatagtattatctgattttcctggaggccacattttaaggactgaggttacaatggcagatgccagccctagaacagaaacatcaacagatgatactgac

SEQ ID NO: 602 - DNA, 310 bp, Zea mays
cagcaagctccctcagctcggtcttctcggcaggacccggcaagcagagccaaagccaaagccccgctcttttctcgacgacgtggacgtgaatcgatcgggagatcgagacatggggcgcgctccgtgctgcgagaagatggggctcaagaggggcccgtggacgcccgaggaggacaggatcctggtggcgcacatcgagcgccacggccacagcaactggcgcgcgctgcccaagcaggcgggccttccccgctgcggcaagagctgccgcctccgctggatcaactacctgcgccccgacataaag

SEQ ID NO: 603 - DNA, 302 bp, Zea mays
acggagagatggagcggctgatgcgtgacaagagcatcctgctggcggaggtggtgaagctgcggcaggagcagcagagcacgcgggcgggcatgcgggccatggaggagcggctgcggcaccggagcacaagcaggtgcagatgatggggttcctggcgcgggcggtgcagagcccagacttgttccagctgctggcacagcagcaagcccggctgatggagctggagggcgcggcgctgctctccgccgcctcccggaagcggaggcggcccatcggcgccgcgccggccaacggcggct

SEQ ID NO: 604 - DNA, 317 bp, Zea mays
  unsure (1)..(317): unsure at all n locations
ctgggaggagcccaggtgctgagtttggaggatctcagcgtgcccaccaccccttgccatggattcgaacccctcctaacgccgcnctcgcccaagaaccggagcatctcgccggaccggaaggtgaacgaggagattcttcggcagctgggggagctcgcagagtctgatggcggtatgcaggcatcagcaggtcgtgaggaggcagagcaagctggtggagaccagttcccttcctgggcgtcaccacagtatgccactggacatggcaattttggaacagaggacaaccatgagaatggcagatggaacaacag

SEQ ID NO: 605 - DNA, 285 bp, Zea mays
gtcagccacggtgctcctgctgctggtccggaggcagccacgcttgcaagatggatctgccagagttacaggttccatttcggggctgagcttatcaaatccgcagacggtagcggctgtggtgaagcagtgctgaaaactctctggcaccatgccggcgctatactctgctgctctctcaaggccttgccagtgttcacgttcgcgaaccagtccgggctcgacatgctggagacgacgctggtggcgctgcaggacatcgcgctggagagagtgttcgacgac

SEQ ID NO: 606 - DNA, 139 bp, Zea mays
gcagcagcgacgacgacgaggccggcgccgccgacctccggaggggcccctggacggcggaggaggacatcctcctcgtcaactacatcgccgcccacggcgagggccggtggaactcgctcgccctctccgcgggcct

SEQ ID NO: 607 - DNA, 290 bp, Zea mays
atcaaatccgcagacggtagcggctgtggtgaagcagtgctgaaaactctctggcaccatgccggcgctatactctgctgctctctcaaggccttgccagtgttcacgttcgcgaaccagtccgggctcgacatgctggagacgacgctggtggcgctgcaggacatcgcgctggagagagtgttcgacgaccaagggaggaagaacctgtgcgcggactccccggcgtcatggagcaggggttcgcgtgcgtccccggcgggatgtgcgtgtcgggcctaggccggccg

SEQ ID NO: 608 - DNA, 262 bp, Zea mays
cgaacccacaggacgtgaagaggatgcgacggatggtgtcgaaccgtgagtctgcttgacggtccaggaagaggaagcaagcccacctagctgaccttgagacacaggtcgaccagctgcgaggcgagaacgcgtcgctcttcaagcagctgacggacgccaaccagcagttcacgaccgcggtcacggacaacaggatcctcaagtcggacgtggaggccctcagagtcaaggtgaagctggcggaggacatggtggcgcg

SEQ ID NO: 609 - DNA, 257 bp, Zea mays
cgatgcaaagactccatctgaagtttaggtactagcttgccatgagatatatattcttctgtaagaacatcacttgcatgctctttttgtcatatctactccttctgttccaagtataggacgttttgacttttctagacagataacttttggtatgcatttagatatgcattatgtctggatacatagaaaaacaatatatctagaaaagccaaaacattctataatttgtaatagagggattatatgattacttc

SEQ ID NO: 610 - DNA, 295 bp, Zea mays
attttaaaatttcaaattttaaattttccatacgacctcggatggtaaaaccacaaaatggaaagttttaggttttcaagacttatgaaactttgtagctaacaactttttcatttgaaatcatttgatcatgcaaaactatatttgaaattcaaaatttgagattttcaaacggcctcaaatgaaaaaacaaacaaaatgaaagttgtagatctcaaaaagtaatttaacattgtagttgacaacgtttaaatttgaatcatcttatcatataagaatacatttgaaattttca

SEQ ID NO: 611 - DNA, 294 bp, Zea mays
cgccaaacacctgcctggcaggaccgacaacgaggtcaagaaccactggaactcgtacctcaagaagagggtcgagggcaaggatggacccagcacgccgccgtccgattcagacgactcgcattgcgccaagcccgggggcggaagcacggcgcgggagacgggagacgaccgcccagcggactactccggctcgtcggagccgcgcgagccgtcgtcgtcgtcgtcgcccgacacgagctgcctgacgggcccgcccaaggtcatgttcgtggactggctcgacatggactg

SEQ ID NO: 612 - DNA, 157 bp, Zea mays
ccttaattcatcccagaattttgagggatggtttaatgcaccatttgcatgtgatgtcagtcttaatgatgagggacaactactaatcatacatcggttgcatcaagttttgcgtccattcttgctgaggaggaagaaagatgaagtagagaaatat

SEQ ID NO: 613 - DNA, 301 bp, Zea mays
  unsure (1)..(301): unsure at all n locations
cttttaaccactggatggagtgcctttgtcaacaagaagaagcctgtctcaggggacgccgtactatttttgaggggtgataatggggagctaagacttggagtgcgccgtgcagctcagcttaaaaatggatctgcttttccagctctttataaccagtgcttaaatcttggttcactacctaatgttgcacatgctgtggccaccanaagtgtgttccacatctactacaaccccagatgtaagccaatctgaattcagtatcacattttcgaagtttatcaagagcttcagtcaacca

SEQ ID NO: 614 - DNA, 310 bp, Zea mays
cctgccgggccgcacggacaacgaggtcaagaactactggaggacgcgggtgcagaagcacgccaagcagctgcactgcgacgtcggcagccgcaggttccacgacgccatgaggaacctctggatgccgcgcctgatcgagaggatccacgccgacgactcagccgccgtcgccgctaatgccaccggcgacgtctcccacttctactccgcgagcccatcgcatgagctgtcgtcgtcctcccagccggcgccggcgtaccgaaacgctgcgcccaacggcagctgcgcgcgtgcgccgtccccggac

SEQ ID NO: 615 - DNA, 289 bp, Zea mays
  unsure (1)..(289): unsure at all n locations
atcgaaaatgacattagctgatgatgtgaacttggaagagtttgttatgaccaaagacgagttttcgggtgctgatattaaggcaatctgcacagaggctggattgcttgccttaagagaacgcagaatgaaggtgacccatgcagatttcaagaaggcaaaggagaaggtgatgtacaagangaaggaaggtgttccggatggtctctacatgtagccaatctattcatcatgccgaacaagttacccgattgtgtgtgtactagcacatctcttcatcatgggagat

SEQ ID NO: 616 - DNA, 290 bp, Zea mays
aacgaacccagattttcaaaacagaccgctcccggcggccatgcccatgccgatggtgcggcacggcagcggcggcgctgagcccgactgccagaaaccggccacgggatcaggtccgtcagaccgatgcctgcgcccgtcgcacctgtaacctccaggctgaagcgggaagactgcccccgcaccaagcacgactccctcttttccccatggaaggtccttgtcgggccgtcggactggagggaccacgccgccggcaaggaaggggtccagaggtaccgcatccgcaa

SEQ ID NO: 617 - DNA, 276 bp, Zea mays
gtgcaaaagaaggtctttagtttcaccaagatcggcagatcgccaacatccgtctgcctctcctctccggtgccggcgactgacacaccacagggtcatctgcacaccaatagggtctgcgacaatgtctggacattcattctaacagatgcaaccttcaagagcgctgagattcaagaaacaccgagcaagatgggtctcaatgcggtggtagccgcctgctacgtctttccagtacttgtctctgtgctcgcagtccgcttcttctacgtactg

SEQ ID NO: 618 - DNA, 315 bp, Zea mays
ggatccgactctctaggacagtcatgtactactagcttgttgcacatatgatggccagcaaagcaagaactgatcaaaagttagtcagcactgaacaagatcacgttttttttgtggttgatgttcttggggccaggctgttcctcttaggcctgaagaaatacggcaagggggactggaggaacatatcgcgcaactacgtccagacgcggacgcccacgcaggtggccagccacgcgcagaagtacttcatcaggctcaactccggcggcaaggacaagaggaggtccagcatccacgacatcaccacggtga

SEQ ID NO: 619 - DNA, 297 bp, Zea mays
ccagaattggggagggattgatatagatggaaacatgctaacctttatggttggttcaaagcaagcatttgaggtgtccctaccagatgttgcacaaacccagatgcaaggaaaaacagatgttctcttagagcttcatgttgatgatactactggagccaatgagaaagactccctcatggatttgagttttcatgtgcctacttcgaatactcagtttgttggggatgagagtcgccctccggctcatattttatgggagaccatattgaaatttgctgatgttggttcttctga

SEQ ID NO: 620 - DNA, 287 bp, Zea mays
agatcatgaaggccgacgaagatgtccgcatgatctcagccgaagctcccgtggtcttcgcaaaagcttgcgagatattcatactggagctgacgctgaggtcgtggatgcacaccgaggagaacaagcgccgcaccttgcatgaagaacgacattgccgcagccatcaccaggaccgacatttacgacttcttggtcgacattgttcccagggatgagatgaaggacgacggaatggggattcctacgcccgggctgccacccatgggagccccagctgacgcata

SEQ ID NO: 621 - DNA, 284 bp, Zea mays
gcgtctcgaccacgtcgcagttcgatgacatcttcactaaggggctatcgtcgagtgtattcattgagtttcgctgcagtctcaacatcggtacatgatagagttgagactgcggggagggggtgttagactccttgttagacatctgtacatgatacctgatgacccatattgtaatgggcttggctcatctaacttctctatataataatactcccaaccctggattagggttagggtttcccacattctaactacgcaaactgacatatttgttatttttc

SEQ ID NO: 622 - DNA, 284 bp, Zea mays
aacagatgttctcttagagcttcatgttgatgatactactggagccaatgacaaagactccctcatggatttgagttttcatgtgcctacttcgaatactcagcttgctggggatgagagtcgcccctcggctcatattttatgggagaccatattgaaattcgccgatgttggtccttctgaagaaccagttgtcacatttgaaggaactgcgatccttacaccaagaggacgttatagtgtctgaacttcatcctgcatttctgcgactccaaggacaagct

SEQ ID NO: 623 - DNA, 301 bp, Zea mays
cccatgcgtccgcccacgcgtccggtcaacggtctcgagctacgcttctgccagcagtgcagcaggttccacaacctggccgaatttgaccagcaaaagaaaagctgtcgcaagcgtctagcaggccacaacgaacgccggagacggccacctcctggaccccttgcgtcacgatatggccgtctcgctgcaccgctcggtgaatagcccggcggcaggttcagaagcttcatgctggatttctcatacccaagggttccaagcgccatgaggtatgggtttccatcggttcgacctggtg

SEQ ID NO: 624 - DNA, 305 bp, Zea mays
gattctagtaaagggttgggttttactgaggttgcaaaagcccgtgcgagtacaaacaaagttgtttgttgccatttctcattggatgggaaacttcttgccaccggagggcatgataaaaaggtcgttttatggtttacagatgtgctaaaacgtaaatccgcattagaagagcactcttccctaattacagatgttcgatttagccctggcatgacccgccttgccacatcttcctttgacaaaaccgtgcgggtttgggacgctgacaatccagattattcgctccgcacttttacaggtca

SEQ ID NO: 625 - DNA, 287 bp, Zea mays
gcctgccgcggcggcctctgcctccggcggcggggcggccgggtccgcggagtcgtacatcgggagcctcattagcctgacttcgaagagcgagatcaggtacgagggcgtcctttacaaaatcaacaccgaggagtccagcatcggcctgcgcaatgtgcggtcctttgggaccgaatgtcggaagaaagatggaatgcagattcctgctagcgacaaagtatacgagtatatcctctttcggggaactgatatcaaggatttgcaagttaagtcatcaccaccgc

SEQ ID NO: 626 - DNA, 283 bp, Zea mays
gccggcgtcagtacccacgcgatccgcggcacggtggtcgcgacgcgtggggccgtctcctcctccgtcccatcactctctgctcgggcactctcacctgcgcgcgccgtcttcgaccgccaccaagatgaccaaggagaggctcattgcagaaaggcaattgggggtccggggggttgttttccgcagaggcggcaagggcaccatgcgcacgaagaagaaggctgtacgcaagacggtcaccacggacgacaagaggctgcagggcactctcaagagagta

SEQ ID NO: 627 - DNA, 153 bp, Zea mays
cttctccagcttcgtcaggcagctcaacacctatggcttcaggaagatagtcgcggacaggtgggagttcgccaacgagttcttcaggaagggcgccaagcacctcctcgcagagatccaccggaggaagtcgtcgcagccgctgccgacgcc

SEQ ID NO: 628 - DNA, 312 bp, Zea mays
atatcatcaagaaaaccaaagaaaagcgccagaagaagaaacaggagaacgctgatcccaaccggcccaagaggccagcctcttcctttcttcttttcagcaaggaagagaggaaacagctgatcgaggaacgcccgggcatcaataactcaaccctgaacgcgctcatcacggtgaagtggaaggaactgagcggcgaggagaggcaggcctggaatgcaaaggccgcgcctgccatggctgcgtacaagaaggagatggaggagtacactaaggcccaaagctcatctgcttgacagaataactaattcc

SEQ ID NO: 629 - DNA, 308 bp, Zea mays
aggccaccacgcacaaccgctccaaccatggacgccggccccgcgcgtccatcggcaccgtcgaccgccgcagtcgcgggggcctccgtcgcggacgagccccgggacgcgcgggtggtgcgggagctcctgcgctccatgggtctccgcgagggcgattacgagccccgcgtcgtgcaccagttcctggacctgtcctaccgatacgtcggatagtgctcggggacgcccaggtctacgccgaccacgccgggaaggctcagatcgacgccgacgacgttcgcctcgccatccatgccaaggtcaat

SEQ ID NO: 630 - DNA, 297 bp, Zea mays
cggacgcgtggtcgctttccagttctcatacgagaatcacctacgagaaagcgtcgcagcgatggccaggcaatatgtcaggactgtggtggcatcggtgcagttggtggccatggcaatagctccttcccgtcttggtggacaggttgagatgaagcaaacacctggttctcctgaggcgcacacgcttgcgaggtggatcggcaggagctacaggtttcacactggagcagaactgcttcgcacagacacccaatgcacggatgcttccttgaaagcactgtggcagcactcgga

SEQ ID NO: 631 - DNA, 293 bp, Zea mays
atctgagattgatggaacaattcaaatgtaagtatatagccactcgagctgaatgttacactaattctctcgagtggctatatacttacatctgagattgatggaacaattcaaatgaaaagttacctcactggcaatccggaaatccgtcttgctctcaatgaggatttgagcatcggaagaactggatcttcttcatacgattacagaagcacttctggaggaggaacagtcattcttgatgattgcaatttccatgagtcagtacatctggacagttttgatattgacag

SEQ ID NO: 632 - DNA, 108 bp, Zea mays
cccacgcgtccgaacccaaatcccaagcaaccacttcgtcgaccatggggcagggcactccgggagggatgggcaagcagggcggcgtcggcgaccgcaagccggggg

SEQ ID NO: 633 - DNA, 307 bp, Zea mays
gtttagttgcaccctggatggttgtgatatgaggttcagtatgaaggcagatatgcaacggcatgttaaggaaatccatgatagtaagaacccccatcaatttgtttgtaaggaggacggctgtaacaaggttttcaggtattcatcaaagctgaagaaacatgaggaatctcatgttaaattggactatgtggaggtagtgtgctgtgagccaggttgcatgaagatgttcagaaatgttgaatatctgagggctcataaccaatcttgccatcagtatgttcagtgtgagatatgtggagaaaag

SEQ ID NO: 634 - DNA, 311 bp, Zea mays
cccacgcgtccgcctgattggtctcagttccaggcatactataatgctgctgggacagctccagtgaccccacctttttttcatccatctgtagctccaagccatcaggggcacccatatatgtggggtccacagggccagggtattaccccatgacctggtgaaagggaccactgagccgtaatgcaaccattgtaactctggagataatccgtcatctaacatttgattattcaactggatagatgatgtctccttatgggacaccaccgccatatgcagcaatgtatgcacaaggtacaccatatcag

SEQ ID NO: 635 - DNA, 290 bp, Zea mays
atcctggggccccgggaacaacagcttcatcgtctggaacacgcccgagttcgcccgggacctcctgcccaagtacttcaagcacagcaacttctactccttcgtcaggcagctcaacacctacgggtttagaaaggttgatccagacagatgggaatttgcaaatgagggttttctgagaggacagaagcatctgctgaagactatcaacagaaggaaaccatccttgcaggggaacagccaaccacagcaacctcagtcgcagaacgctcctgtgccttcctgtgtag

SEQ ID NO: 636 - DNA, 311 bp, Zea mays
ccgcgctccgccaatccagagagcgagccagcccgagctcacacagcagcgagctcggtcttctcgccaggacacgaacacgaccccagcaggcggcaggcaagccacgctctctcgacgggcggacgttaatcgagacatggggcgctctccgtgctgcgagaagatggggctgaagaggggtccgtagacggccgaggaggacaggattctggtggcgcacgtcgagcgccacggccacagcaactggcgcgcgctgcccaagcaggcgggcctgctccgctgcggcaagagctgccgcctccgctgga

SEQ ID NO: 637 - DNA, 306 bp, Zea mays
aaaaccacccgcgctccgccaatccagagagccagccagcccgaggtcacacagcagcgagctcggtcttctcgccaggacacgaacacgaccccagcaggcggcaggcaagccacgctctctcgacggacggacgttaatcgagacatggggcgctctccgtgctgcgagaagatggggctgaagaggggtccgtggacggccgaggaggacaggattctggtggcgcacgtcgagcgccacggccacagcaactggcgcgcgctgcccaagctaagcaggcgggcctgctccgctgcggcaaga

SEQ ID NO: 638 - DNA, 329 bp, Zea mays
gttgaaaaggcacctttggagtcttatgctgacattggtggcttggatgctcaaattcaagaaatcaaagaagcagttgaacttcccttaacacatcctgagctatatgaggacattgggatcaggcctccgaagggagttatactatatggggaacctggaacagggaaaactctactcgcaaaggctgttgccaattctacttcagcaacgttcttgcgtgttgttgggagtgaattgatccaaaagtaccttggtgatggtcccaagcttgttagagaattgttcagggtggctgatgatctttctccttcaattgtctttattga

SEQ ID NO: 639 - DNA, 113 bp, Zea mays
cggacggtgggcgtacgcgtgggcggacgcgtggagtccacctagctgaccttgagacacaggtcgaccagctgcgaggcgagaacgcgtcgctcttcaagcaactgacggac

SEQ ID NO: 640 - DNA, 102 bp, Zea mays
  unsure (1)..(102): unsure at all n locations
ccccacgnctccgacgacggtggncgaaccagtgggcgcgcatctcgtcgctgctcgtccgcaagtccgccaagcagtgcaaggcccgctggtacgagtggc

SEQ ID NO: 641 - DNA, 298 bp, Zea mays
aataccacaacctcttcaatttcatcaatggaaagaacattaaaataatgaaccttggaggagatggtcaaggtgcaagtggtgtagttacagatgttctacgagacactgatgatgatgctgttgatccacatctagagcgtattaagaatcaggccggggatgaggaaagcgatgaagaggatgaagattttgttgcagacaaggatgatagtggatctcctactgatgactcaggtgatgaggaatcagatgctagtgatagtggtggtgaaaaggagaaatcatccaagaagga

SEQ ID NO: 642 - DNA, 230 bp, Zea mays
gtcaggttgaaggctgcaaggttgatctctcttctgctaaagagtaccatcggaagcacagagtctctgtacctcattctaaggctcccaaggtggttgttgctggtctggagcggcgcttttgtcaacagtgtagccggttccatggattagctgagtttgaccagaagaagaaaagctgccgcaggcgcctcaatgatcacaatgcccgcagacggaaaccacaacct

SEQ ID NO: 643 - DNA, 231 bp, Zea mays
cgaaacgtggccaatgtatgctgtgtacaattctctccatactcctcccgcatgctagcttttggttcagctgattacaaaatatactgttatgatctgaggaacacaaggataccttggtgtactatttcgggacatggaaaggctgtcagttatgtaaggttcttggatccagaaacacttatctctgcatcaaccgacaacacattgaagatatgggatcttaaccag

SEQ ID NO: 644 - DNA, 242 bp, Zea mays
cactgatgctgcaacccttcaactgcaagtaacaatgaagcagctgagactgagagatactagtgcttccctgcacattattgagtccttgttgggttggtcggtagcagctgatgtttctaaacaaaaacaatactctggatatataccgacgacgccaggagttccatggagcgatgaggagcacaggcagttccttgccggcctggacaagctgggcaagggcgactggcgaggcatcg

SEQ ID NO: 645 - DNA, 238 bp, Zea mays
cggacgcgtgggtgcgctttctggcttcgttgcttgcgtgaaggattagtaaggcgcgtgatggcgctctcagcttgcccggctcaggaagaactgctgcagcctgctgggaggccgttgaggaagcagcttgctgcagccgcgaggagcatcaactggagctattccctcttctggtccatttcaagcactcaacgaccacgggtgctgacgtggacggacgggttctacaatggcg

SEQ ID NO: 646 - DNA, 224 bp, Zea mays
aggaccggatcagcatcctcccggacggcgttatcggcgagatcgtcacccgccttcccaccgccgatgccgtccgcgttcaggtcctctctcgccgttggcggcacatatggatctcctgtccgttgaacctcgatctcggttccccaaactactacaccgactacaagcgcgtcgtgtccggaatcctcgcggcccaccctggcccctgccgccgcctcaaa

SEQ ID NO: 647 - DNA, 285 bp, Zea mays
  unsure (1)..(285): unsure at all n locations
gcggacctgagtacggccggaatccgggcgaccacgcgccgggacgctggttttataagggtttcggcggaggcgcccggtcgctggcgatggccgacgacggcgagaccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcatcgngtacagcgaggcc

SEQ ID NO: 648 - DNA, 270 bp, Zea mays
atgagcagaaggaagagaaggtctagcctttttgacatggtgcctgatgagtccatggaccttccaccccttcctggaagtcaagagccagagacctcagtgttaaatcaaccagcactggctccccctgtggaggaggaggaggaggttgaatcgatggagtcagatacttctgctgttgcggagagttctgcagcttcagctcttatgcccgagagtttacagcctacctatccgatgattgttccagcttatttctcaccgttcttg

SEQ ID NO: 649 - DNA, 229 bp, Zea mays
  unsure (1)..(229): unsure at all n locations
cgtagatcggtttgtgagaccccaacttgtgagcttaatcattcatccgcaatattctagattgtgttctttcttgttcttgcttgtgtcttcgattctcaggcaggaattagccctcgtggcgaggtcaatcgcgcagcnacggttgataaccagaggagaagtggtgctgcgattgcggggttctagtcgtgttgattggaagccggatcgtttgtgtgacatctcc

SEQ ID NO: 650 - DNA, 152 bp, Zea mays
caaaaagcttggccgttgcatttccccccgagaagaagcccggatacttataggttaattagaactaatttatgatatacattcagactaattattctacacatcaaaggtatttatgtaatgcggtacaatatatatatccggttaacaaa

SEQ ID NO: 651 - DNA, 258 bp, Zea mays
cccacgcgtccgacacgcgtccgcggacgctggcgtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaacca

SEQ ID NO: 652 - DNA, 259 bp, Zea mays
cccacgcgtccgcccacgcgtccgcccacgcgtccgggcggcaccgcgcgacttttggactctccgatacactagtggtcttgaggatggcagtcttgtgatctgtgagagatcactgacacaatcgactggaggcccatcaggacccaacactccaaattttgtaagagccgaagtgcttcctagtggctatctaattcgaccctgtgagggaggtggctccatgattcacattgtggatcatgttgatttagatgct

SEQ ID NO: 653 - DNA, 223 bp, Zea mays
attgatcaattcatctcaagtcgaaaaagggtcaagttttagctcctccatgatgaagacgtttcagcgtggtcttctgagttcaagggatggtgaagcttcaaagttgactgaaaatggcttccaatttcttctgatggaaacaaatgcacaactttggtacataatgagagaatacatttcatctgctgaggaacgtggagtggaccctacggagctgata

SEQ ID NO: 654 - DNA, 221 bp, Zea mays
atttaagttggattatataatctagaaggtaaataagttaaaaatcaaacaaacaatacagattattaggtgaattatataatctagatacctagattatgataaatccataaccaggtcactaggtgcttacataatccataagctggattatatgatcctggaagtaaacaaacagggccaagtctcttacaatttgccttgtttgccatgaccttctg

SEQ ID NO: 655 - DNA, 253 bp, Zea mays
catgtctatcacaaccttcaaaatcggttaactaaaacattgatccatgcatttcttgatcctgccaaatcactgacacaacattatggtgctgtccaagggatatctgcactggggcccagcgcgattagactccttcttttgcccaaccttgtgacatatatgcaacttctggagccggaactgcagcttgagaagcagaaaaacgagatgaaaaggaaggaagcttggcgtgtttatggtgccttgctgt

SEQ ID NO: 656 - DNA, 245 bp, Zea mays
gcaaagcaagaactgatcaaaagttagtagcactgaacaagatcacgttttttttgtggttgatgttcttggggccaggctgttcctccagtaccccttgccgtatttcttcaggcctaagaggaacagcctggccccaagaaatacggcaagggggactggaggaacatatcgcgcaactacgtccagacgcggacgcccacgcaggtggccagccacgcgcagaagtacttcatcaggctcaa

SEQ ID NO: 657 - DNA, 265 bp, Zea mays
caggaacaagatcctgcagcgacaggatgcccctgctgctataatgcaagcgaataaactaaatgatccagaagctgtcacaaagaggtcaaagctaatgctgacgcctcctcaaatttctgaccacgagctagaggagatagcaaagatgggcagtgctggtgatcctgctttagctgatgagcttggtgaaggaagcactgccacaagaaccttgcttgccagctattctcagactccaaggcttggtatgacaccattgcga

SEQ ID NO: 658 - DNA, 247 bp, Zea mays
cgccggcaggtgcgcttctccaagcgccgctcggggctcttcaagaaggccttcgagctctccctgctctgcgacgccgaggtcgccctcatcgtcttctcccccgccggcaagctctacgagtacgcctccaccagcatagaggatacatataaccgctatcagcaattttctggagaaggaaggaatataaatgacgatcgaactagaaacgataacaaggatgaagcttcttcagatttgcagt

SEQ ID NO: 659 - DNA, 144 bp, Zea mays
aatctgagaagtttgatggaaagggtatttcagaacaaactgacaccaagttgacagagaaggccattgttttctctcaatggactagaatgctagacttgcttgaagtccatttgaaagcttctcatgtgacatatcgaaggc

SEQ ID NO: 660 - DNA, 248 bp, Zea mays
ggagcagataaaaactcttgagataaataattacgcacttagagtgcatttgaagcaggctcagcagggcaattctatgcatggacgtttcccgcctgacgtcttctaatgtctgccatggctcaacagaataattatgcatggacgttcgttaatatttgatgctgtacagttggattttgaactaagcagtgtcaaataaaaaaaatcgaggtagtacctattaagataagtagactcaggacctc

SEQ ID NO: 661 - DNA, 272 bp, Zea mays
  unsure (1)..(272): unsure at all n locations
ggcctgcggaggagcggcaagagctgccggctgcggtggctgaactacctgcgcccggacctcaagaaggagcccatctccaagcgcgaggaggagaccatcatctccctgcagcagtcgctcggcaaccggtggtcgacgatcgcggcgaggatgccaggcaggacggacaacgagatcaagaactactggaactcacgcatcaggaagcgcctcaacgcctngcgctccagagctgcangctgcgacggcggtgacagcgcggccgagcc

SEQ ID NO: 662 - DNA, 290 bp, Zea mays
accacggtcaaaacactcggccacagagcagcgcagacgcagcaagatcaatgataggtttcagatacttagggagctgttgccacacaatgatcaaaagagagacaaagcaacatttctcttggaggttattgaatatatacgttttttgcaagagaaagcgcaaaaatacgaggcaacattcccagaatggaaccaagaaaatccaacgatgcttccgtggagtaaaggccaaatcccaggagattccccgcctgacccttcacatttcgtgagaaatggatcctccc

SEQ ID NO: 663 - DNA, 287 bp, Zea mays
cagacgcgtggcggacgcgtggggagaggagacctacactgccttcgaaaacatctatcctgtactgtatgagtttagaaatattcagcaatgatgacatgtgatgtgaaggtcacgttcttcaaattacaagcttcctcgaggattctcgtgtgaccatgaattctaaatgtacataaaagtctggcggaacttatagcatcctgtaatctctgtgagccgcggtctgtcagtattgggtgggcttgctgtggtaactggtggacatgtcgagttcatccatttgg

SEQ ID NO: 664 - DNA, 309 bp, Zea mays
cggacgcgtggcggacgcgtggggccacaactccggccagaagctagctagccaagttattagctagtacatactagtgaccggccggacacgatcgatgggcaggccgccgtgctgcgacaaggcgggggtcaagaaggggccatggacgccggaggaggacatcgtcctggtgtcctacgtccaggagcacggccccggcaactggcgcgccgtgcctgtcagcacgggcctcatgcgctgcagcaagagctgccgcctccgctggaccaactacctccgccccggcatccggcgcggcaacttcac

SEQ ID NO: 665 - DNA, 199 bp, Zea mays
aagagattgaacggctgaaaagggacaagaatgttcttatgcaagagcttgtaaggctgagacagcaacagcaaacaactgaccatcagctccagactttgggcaagcgtcttcaagggatggagtcacggcagcaacagatgatgtctttcctggccaaagcaatgcaaagtcctggtttcctagcacagtttgtaca

SEQ ID NO: 666 - DNA, 236 bp, Zea mays
acggcgcgcagggcgacttcctatcctcctccctcggcaggtggcagaaccgcggctccaaccccgaccgatccctcatcctcgccttccgcaccatcgccaacatggctgaccggctaggtcttgtggctactattaaggaccgagcaaatgaaatctacaagaaagttgaagatctcaaatctatcaggggaagaaatcaagatgccatattagctgcatgcctaaatattgct

SEQ ID NO: 667 - DNA, 331 bp, Zea mays
ggacgcgtggttttttttttttttttttgactcgtcgctgccatttcatatatccaagtactcataaatggataactatttgtttgagttgtgtgtttccaaccaaaataaatgctgtaagcaaacattttcggaccatttaagcagattacaaacgccagttctctcactaagactaatagcgctgctgatgagtctcacatatataagccctccggcacgccttctttcttcttgaacataaccttttctttggccttcttgaagtctgcatgcgtcaccttcatccgccgctctctcaaagcaagcaagccagcttcagtacaaatgg

SEQ ID NO: 668 - DNA, 244 bp, Zea mays
  unsure (1)..(244): unsure at all n locations
ctcagcagggtcaaggactaccaccgtaagcaccgcgtctgcgaggcccacactaagtctccccgcgtcatcgtcgccggccaggagcgccgcttctgccagcagtgcagccgattccatgcgctgtcagagtttgatcagaagaagaggagctgcaggaggcgtctgtctgatcacaatgcccgccgccggaagcctcagccagatgcattcaccttngcctctgnaaagcngccttggacat

SEQ ID NO: 669 - DNA, 258 bp, Zea mays
  unsure (1)..(258): unsure at all n locations
tngctgcccgaggacgaggacgcggagaagcgtgcgcaggcgcgggtccgggacgacgagnacgcggaccgccgcgacggcgaggacggcggcgccatgaggccgctcgcacggacgccgcacatgttctgcaagacgctcacggcatccgataccagcacgcacggcggtttctcagtgccgcgccgcgccgccgaggactgcttcccgccgctggactacagccagcagaggccgtctcaggagctcgtggccaag

SEQ ID NO: 670 - DNA, 274 bp, Zea mays
cggacgcgtggctgtcacaacttttgcttgttctttagcaaagcataggaagtcaagcacattagacgcaaaagatgtactcctacatgcagaaagaagctggaatatcaccttgccaggcttcagtggtgatgaaatcaaactgtacaagaaacagcacataaatgatattcacagggagaggcttgctctgataaagaagtccatggcgactgacacgagaaactctgctgcccaagctgcagctaaccagaaaaatcagactccgaaacca

SEQ ID NO: 671 - DNA, 268 bp, Zea mays
gctgctggtgctggagcgatggagaacggcgatgtaaatgaggatgagagaaatggaaagaagatcagggtgcaaggaggcggctcaagtgggccggcatgccaggttgagggctgcggacagatctgactgcagcaaaggattatcaccgtcggcacaaggtctgcgagatgcatgctaaggccaccaccgccgtggtcggaaacactgtccagaggttctgccagcaatgcagtagatttcaccttcttcaagaatttgatgaagg

SEQ ID NO: 672 - DNA, 266 bp, Zea mays
  unsure (1)..(266): unsure at all n locations
cgcgcactngggcaaccggtggtccaagatcgcgtcgcacctgccgggacgcacggacaacgagatcaagaaccactggaacacgcacatcaagaagaagctgaggaagatgggcatcgaccctgccacccacaagcccctccacccacagccagcagctcctcctccgactcagcaggagcaggacacgggcgggtcgcccgaggaggagggggagaaggccgacgcggtcatgatggcagcagctacgccgattatcgggcacg

SEQ ID NO: 673 - DNA, 276 bp, Zea mays
cggacgcgtggaagctgtgagtctgtggtgacaagtggtcagcacaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtccggattccgttggaatcatcgctgtttcgcacaactgcagcggcgtacagcacgagcttgcggccttgtga

SEQ ID NO: 674 - DNA, 257 bp, Zea mays
gcttctgctgcggcggcggctaacgcgacgatagaagagcgggtgatggggccgtggtccccagaggaggacgcggtgctgagcaacctcgtggagaagttcggggcgcggaactggacgctgatcgcgcgtggcatcccgggccgctccggcaagtcctgccgcctgcgctggtgcaatcagctcgacccccaagtcaagcgcaagcctttcactgaagaggaggaccgcattataatggcagctcatgctgtcca

SEQ ID NO: 675 - DNA, 248 bp, Zea mays
cccacgcgtccgcccacgcgtccgaaagagatctggcattgagtaaagaactgttggttgaaaaatacaaggacaggcttgaggaatcttacaagggtctaatacatgaggtatttaccaaagtccttcgtggtctatctggtgctaaagtcacaaggccaggttctttcagaagttgccaagatggatatgcagttaaatcatctctcaaagctgaagatggactgttgtatccactggaaaagggt

SEQ ID NO: 676 - DNA, 270 bp, Zea mays
ggttgacaatgaagctgcgagattttaacaagtatgccaaggtgaagacctttgaagtgtggattgataaattgtctattataaactgtctgacgtaggtttctagttgtttttttcactcttatagattgtcccactatttagttgcaggaagccaaatagctaaatggcttcatgattttttttacataagaagggcctcatgatctgcttatggattatcataatttaagtatctagattatataattcacctaataatttgtgttg

SEQ ID NO: 677 - DNA, 276 bp, Zea mays
cagaaggaagagaaggtctagccttttcgacatggttcctgatgagtccatggaccttccaccccttcctggaagtcaagaaccagagatctcacagttaaatcaaccgccactgccgcctcctgtggaggaggaggtggaatcgatggagtcagatacttctgctgtcgcagagagttctggagcttctgctctcatgcccgagagtttacagcctacctatccgatgattgttccagcttatttctcgccgttcttgcaattctcagttccttt

SEQ ID NO: 678 - DNA, 267 bp, Zea mays
ctcaccagctatccagatcattggctcattgctgcttccattccattcccccttccctcggcatcggccgcgcccgcccgtgtcgggcgaggcggacgcgcgcgggaatgggacgccacgcggcctccggcggcggcgtgcagcagaagctgcgcaagggcctctggtcacccgaggaagacgagaagctctacaaccacatcattcgctacggggtcgggtgctggagctccgtgcccaagctcgcagggctgcagagatgcggca

SEQ ID NO: 679 - DNA, 267 bp, Zea mays
aggaggagagggagggggagaccatgacaagaggaagcatggatccacaagaaaagagggcaagttggtagatgccaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgc

SEQ ID NO: 680 - DNA, 279 bp, Zea mays
cccacgcgtccgcgcgctagctagctagctgttggcttgagatcgatccgtcgactaagctatagctagcagccatgcggagggcgccgtgctgcgacaaggcgagcgtgaagaaggggccgtggtcgccggacgaggacgccaagctcaaggcctacatcgaggagcacggcaccggcggcaactggatcgcgctaccgcacaaaattgggttaaaaaatgcgggaaaactgcagctgagatggccaattactgaggccaatattaacatggtgcttc

SEQ ID NO: 681 - DNA, 228 bp, Zea mays
cctcatcgtcgaacttcatgctgtactggggaacaggtggtctcagattgcaacaaggttgcctggaagaactgacaacgagatcaagaatctctggaactcgagcatcaagaagaagctccggcagaaaggcattgaccccaacacccacaagccgctccttgtcgaggttgaacgcagcaaagcagctccaacgaccagtaccgagagacctctgagccaatgatg

SEQ ID NO: 682 - DNA, 263 bp, Zea mays
ggacctggggacgttcgagctctccgtcctctgccacgccgaggtcgcactcgtcgtctagtcgccgcgcggcaagctctacgaattcgccagcggaagtgcgcagaaaacgattgaacgttatagatcatacacaaaggataatgtcagcatcaagacagtgcagcaggatattgagcgagtataagctgatgcggatggcctgtcatagagactcggcgcacttgaagcttacaaaaggaatcttttgggtgagaggttgg

SEQ ID NO: 683 - DNA, 232 bp, Zea mays
ctcccaacctcgcatcgctgttcccccaaacccaaatccaaagcaagcacttcgtcggcgggcggcggccgagggcgaccatggggcagggcactccgggagggatgggcaagcagggcggcgctggcgaccgcaagcccggggacggcggcgacaagaaggacaagaagtttgagccgccggccgcgccctcccgcgtcggccgcaagcagcgcaagcagaagggcgccga

SEQ ID NO: 684 - DNA, 246 bp, Zea mays
  unsure (1)..(246): unsure at all n locations
cctagctgcggctgctctgactgcagatcggcgctggtgtctcactggtacaccaattcagaacaatttggaggatttatacagccttttccggtttctgaaagttgaaccatggaggaactgggctttgtggaataaacttgtacagaaaccatatgaagaaggtgatgaaaggggcttaaagctactgcagtccattttgaagccaataatgctgagaaggactanaaattgcacagacaagga

SEQ ID NO: 685 - DNA, 273 bp, Zea mays
cggacgcgtgggcgtacgcgtgggcgcgaccggcagagccagagccacagccacagccaccccgccggcgagtagggccaggggaaacggacgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctgggactccccaggaccgcggactgcaagtgcagcagcagcagc

SEQ ID NO: 686 - DNA, 291 bp, Zea mays
ggacagtgcagtgctccccgaggtccccaaaagacaagcaggcaagcagcaaagacacgcctccctgcttgcactccccacacgcccagtcgcccacacctccaacagacaaagacaatctagcaagcacacacagcatcaggaggaggagatcgagtaggagcagaagcaaagaatggggagagctccgtgctgcgagaagatggggctcaagagggggccatggacgccggaggaggacaagatcctggtcgcgcacatccagagcttcggccacagcaactggcgcgc

SEQ ID NO: 687 - DNA, 281 bp, Zea mays
agtcccttcagcgtgccaccctcgtctactgcgacaacgtcagcgcggtctacctctccaccaatcccgtgcagcatcagcgcacgaagcacgtggagattgacctgcacttcgtccgcgagcgtgtcgctgccggtgacgttcgggttctcagcgtccccactacgctgcaattcgctgacatcttcaccaaggggttaccgtcgagtgtatttttagactttcgctccagtctcaacatctgtacaggatagagttgtgactgcagggggtgttagaat

SEQ ID NO: 688 - DNA, 299 bp, Zea mays
cttcaatctttggcgatggtggtccccttggcgccggtgatctgcatgtgcctgtgatctactgctggctgcatcacctcaatagtctacctgggggcgtatgacagcgaggaggcagctgctcgtgcctatgacctcgcagctctcaagtactggggtcctgagactctgctcaacttccctgcatcaccacaacgggaggtgggaggcacggattgggcgagtctttgggaacaagtacctctacttgggaacatttgacactcaagaagaggcagccaaggcctatgaccttgcgg

SEQ ID NO: 689 - DNA, 227 bp, Zea mays
cgcagagccgcagccaagcaagctgcgcccctggacttggcctcaccggtgaagcggactcgaggataggcggtgctcgggaataccaagcggtcggccgaggccacgtcggcggagatgacggacggtcaccacttcaacaacatcctcctcggagggcgcggcggcacaaaccctggtcagtttaaagtgcattctggtggacttgcatggaagagacaaggtgg

SEQ ID NO: 690 - DNA, 229 bp, Zea mays
gttgaaaattgtggaaggaagccccttggcgaagatgttggtgaactgcgaagttgttgggacgcagagaacgcgtacatcgccgacaacgacacacttgtggatgaagtggaggttgatctccatgtgcttcgtgcgctgacattgcacgggattggtggagaggtagaccgccctgacgttgtcgcattagatgagggtggcgcacgtcaggggggtgtggagctca

SEQ ID NO: 691 - DNA, 315 bp, Zea mays
ctaggcatcaccacaacgggaggtgggaggcacggattgggcgagtctttgggaacaagtactctaattggggaccatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatg

SEQ ID NO: 692 - DNA, 302 bp, Zea mays
cgccgcagcgagataaagcggatcgagaacccgacgcagcggcagtccaccttctacaagcgcagggacgggctcttcaagaaggcaagggagctcgccgtcctgtgcgacgtcgacctgctgctgctgctcttctccggctccgggaagctgtaccactacctctcgcccaccgtgcccactgtcaaggacctggtcgagaggtacgaggccgcgacgcacagcaaggtctgggccgacgttcgccaggagcggcgcgcggagctggagaacgcggagcggatgtgcgagctcatggagaa

SEQ ID NO: 693 - DNA, 183 bp, Zea mays
gtttgacaaagattctattgagagtgatgatagatctcttgaagagctaagctgggagacactagaacttcttgtggtacctcatatattcagcatcagacgaagcacatggagatcaaccttcacttcgtccgtgagcgtgtcgccgacggtgatgttcgcattctcagcatcccgaccact

SEQ ID NO: 694 - DNA, 347 bp, Zea mays
tcactagcgaggcgagtgacaagtgccagagggagaagcggaagaccatcaatggcgacgacctgctgtgggccatgagcacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcagcaaggaacatacaaccaaggaatgggttatatgcaacctcagtaccataacggagatatctcgaactaatgaagacatggaccttttctgcaacagctg

SEQ ID NO: 695 - DNA, 317 bp, Zea mays
cacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccagggcctcttcaagaaggcccaggagctctccgtgctgtgcgatgccgacgtcgcgctcatagtc

SEQ ID NO: 696 - DNA, 127 bp, Zea mays
attccaggtgctcacgcctggacgacgccgtacggggccagcattttccagtccaaggagtcgtcctcagtcctgagttgtgacatctccagaaatagcaaatacatcgtgacaggctcgggggaca

SEQ ID NO: 697 - DNA, 303 bp, Zea mays
atgacacttaagggaatatactgattctgtctccatgctctcctcaccactttctgcacagtggaccctggaaaaaaagcattcatcaacaaatatcacaagttcacggcgatcatttcatatttgttacatacttacatgaacacccaatctaccagttgttatgacaaataccaaatggaaacagaaggactgtttggtttgttgcctaacttgccacactttaactaactttttctgcctaaggttagttcttcaatacgagcgactaaccttagccaaagtgtggcacagttagccgcg

SEQ ID NO: 698 - DNA, 240 bp, Zea mays
tagccaaaccaagcaagcagggaatccccacaaggcagcagatggaagcgaaaggtggcggtggcccgcgcgctgccaggtcgacggctgcaacgttgacctcaccgacgtcaagcccgcctactactgccgccacaaggtgtgcaaaatgcactccaaggagccccgcgtcctcgtcaacggcctcgagcagcgcttctgccagcagtgcagcaggttccaccagctggctgaattcga

SEQ ID NO: 699 - DNA, 227 bp, Zea mays
cttctggagccggaactgcagcttgagaagcagaaaaacgagatgaaaaggaaggaagcttggcgtgtttatggtgccttgctgtgtgctgcaggcaaatgcttgtatgatcggttgaaactatttcctggtttgctttctccgtcgatgcggcctcttttacagagcaacaaaagggtcttaaccaacaacccagataagcgaaaatctagcacagatctctctgc

SEQ ID NO: 700 - DNA, 285 bp, Zea mays
gtgaatatctcagattcttcttcagattcagatgatgaggaacatggaccaagtaaagaggactgcattcgtcagtttaaggtgatgctaaaggaacgaggagttgcaccattttcgaagtgggagaaggaacttccaaaaatagtttttgacccacgctttaaggctattcctagtcactcaacaaggcgggctatatttgaccactatgttcgcacacgtgctgaagaggagcggaaagagaaaagagctgccctgaaggctgcagtagaggcgtataaagaa

SEQ ID NO: 701 - DNA, 241 bp, Zea mays
gatctggagtctttgaatccaaaagagctccaacaactagagcagcagctggagagctcactgaagcacatcagatcaagaaagagccaccttatggccgagtcaatttctgagcttcagaagaaggagaggtcactgcaggaggagaacaaggctctacagaaggaactttcagagaggcagaaggcggtcgctagccggcagcagcagcagcagcaggtgcagtgggaccagcagacac

SEQ ID NO: 702 - DNA, 291 bp, Zea mays
ctctttttctctcctgctcagccttgcttcccgtcccatcctttctttcccttgggcgcattcagcagcttcagcctggccggccggcctgctattaaaccactttgcttgcaagtccaagaaactgctagagaggaacaagctgagatctccagcatggggaggggaaggattgagatcaagaggatcgagaacaacacgagccggcaggtcaccttctgcaaacgccgacatgggctcctcaagaaggcctacgagctctccgtcctatgcgacgcgaaggtggcgctc

SEQ ID NO: 703 - DNA, 280 bp, Zea mays
gatgaagcctggtccggattccattggaatcatcgctgtttcgcacaattgtagtggcgtacagcccgagcttgcggcctagtgagccttgagcccacaaaggtcgcggagatcctcatggatcgcccttcttggtaccgcgattgtcggtgtgtggatattctccatgttatccctacgggtactggtggaactatcgagcttatctacatgcagacttacgccccgacaactttggcggcacgcgcgacttttggatctcgatacactagtgtcttga

SEQ ID NO: 704 - DNA, 255 bp, Zea mays
cgcgagaatacgtgcgtgcagccacaggcacgagtcggcaccatgactactttcaccggcacgcaggacaagtgcgcggagtgcgacaagaccgtccacttcatcgacctcctcacggccgacggcgtcacctaccataagagcgtgcttcaagtgcagccactgcaaagggatcctctcgatgtgcagacactctgccatcgacggcgtgctgtactgcaggacccacttcgagcagctcgtcaaggagaccgg

SEQ ID NO: 705 - DNA, 201 bp, Zea mays
agccttgtgttcgtggggggtgtgtggcatattagctagcggataagcggccggccgaagagcaaccgcagtgagaagaagaagctcggatcggaggaggtcggcatggggaggggacgcgtcgagctgaagcggatcgagaacaagatcaaccgccaggtcactttctccaagcgccgcaacggcctgctcaagaaggcc

SEQ ID NO: 706 - DNA, 264 bp, Zea mays
  unsure (1)..(264): unsure at all n locations
ggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaancattagactgctggatg

SEQ ID NO: 707 - DNA, 144 bp, Zea mays
cgagcggcgcaagggcgtgccgtggacggaagaggagcacaggttgttcttgttggatctggacaagttctgcaagggcgactggcggacgatctcgcgcaacttcgtcatctcgcggacgccgacgcaggtggcgagccacgc

SEQ ID NO: 708 - DNA, 262 bp, Zea mays
aattgaagcatagttgtgcagaacccttccttgctcaacaaattgatcaaattttaccttagatcttcgaaatagagcttcatagaaatccttctcagcctcagataaaacacagtattttacttcaatgtttgcagggggtaaattaaggattggcctgccctccttgtctgtgcaatttttagtccttcctcgcattattggcttcaaaatggactgcagtagctttaagcccctttcatcaccttcttcatatggtttc

SEQ ID NO: 709 - DNA, 248 bp, Zea mays
ggaagatcgtattcttgctctccaggagagaaagcgggagatggttgcttctgcgtttggagaagacaaatctggttcccgacagactcgattgaccgttgaagacctgaattatctgtttatggtgtagaatcgctcctgagagtgagcagttttgctcattggattggtgttagacgtgtgagataaaatgttctctgaagaagtaccaaaggctttcattgggggatatgtagtcctggaagctt

SEQ ID NO: 710 - DNA, 273 bp, Zea mays
atccgagttcgtctcaaaggcatcgcctttcttcctggcagcagagagagagatggcatcctcctcgaccacgaatacatcagatggtggtgcaaagtcatcgtcttgcccgagaggacaatggcgacccggcgaggacgagaagctgaagcagctcgtcgagaagtacgggccgcagaactggaactccattgcagaaaagctggaggggagatcaggcaaaagctgccggctccggtggttcaaccagcttgaccctcggatcaacaagcg

SEQ ID NO: 711 - DNA, 167 bp, Zea mays
acaaggaccgagcaaatgatatcttcaagaagattgaagatctcaagtacattaggggaagaaatcaagatgccatattagccgcatgtctatatattgcttgtagacaagaacatcgccctagaactgtgaaagaaatatgttcggttgctaatggggccacgaag

SEQ ID NO: 712 - DNA, 160 bp, Zea mays
aagcgtccttctttatggacctccgggcacaggaaagacattgttggcacgtgcggttgctcatcagccttcatcagggtgtctggttctgagttggttcagaagtatattggtgagggctcccgaaatttatggatgatattgactctctcggatctgc

SEQ ID NO: 713 - DNA, 257 bp, Zea mays
ctcgagccgaagggagagtggcggaggagggacccatggggacaaggggtcggcgaagtccgccgagcaggagcgtaggaagggcatcgcctggacagaggacgagcacagattgttcctccttggacttgaaaagtatggcaaaggtgactggcggagcatctcgcgaactttgtgatctcaaggacgccgactcaagtagctagtcatgcacagaagtactttatccgtctgaactcaatgaacagagaaaggcg

SEQ ID NO: 714 - DNA, 251 bp, Zea mays
ctatgactgctttgaggcgacgactgctttcaagaaccacaacttgccacttgcgaggataaagaagatcgtgaaggccgatgaagatgttcgcatgatctcagctgaagctgctgtagtctttgcaaaagacgatgagctcttcatactggagctgacacttaggtcgtggatgcacactgaggagaacaagcggcgcaccgtgcaacagagtgacattgcagcagcgatcactaggactgacatttatg

SEQ ID NO: 715 - DNA, 259 bp, Zea mays
ggctgctcttcctgcgggcaagcttgatatgctctatgactcagcctttatctgtgaggcagtactcaggtcacttcctccactggcaaagaagtatgcactgcagatgttgtatgtgctggcaccagtgaccgctgcagcaatggaagagtgggtgcttgatgaatatgctgccaagcataaggttgccattgataagcttctacagctcagggtctttgctgaagtgcgcgacagacgacgggacgtgagctacaag

SEQ ID NO: 716 - DNA, 131 bp, Zea mays
gaaaaaagggatcaaggtgttacctgatggtcgggttactaagattcctcaagggatggtgacggaccaatttggaatgattggtctgttaagatatatcagggcagcagagacagacccaggaatggtac

SEQ ID NO: 717 - DNA, 262 bp, Zea mays
gcggcggatgtcatcgcctggtgccgggaccgcatgccgcactacatggtgcccaagacggtggtgctccgcgctgagctgcccaagacctccactgggaagatccagaagtacgtgctgcggaaccttgccaaggagatgggacccacccgaaagggcgccagtagcagcagcaggatgtagggcctgtttggtttgtggctaactatgccacactttgcctaaggttagtcgttcgaattgaagaactaaccttaggcac

SEQ ID NO: 718 - DNA, 267 bp, Zea mays
gctagttttcagtggattagctagcttggcaatatatatttaactaataaggcggcggtggcatggacgcgatcagcagcctgctgctgcaggagggctggaggaagggcccgtggacggcgctggaggacaggctgctcaccgagtacgtgcagcagcacggcgagggcagctggaactccgtcgccaagctcacagggctgcgccggagcgggaagagctgccggctgcggtgggtgaactacctccggccggacctcaagcggg

SEQ ID NO: 719 - DNA, 283 bp, Zea mays
cctgcaggcacctcatgggagatgttctttaaactttgaatctcaaagagcttcagcaactagagcagcagctggagagttcactgaaacatatcagaacaaggaaggtagtatgatctatatattagactgcagtgcattacttacgtgatgcctactacaccactgacagccatgcgctctgcatgttggaaaactaacaagtaaatattcaccgcatgcgcagagccagcttatggtcgagtcaatttcagcgctccaacggaaggtaaattgttgagct

SEQ ID NO: 720 - DNA, 248 bp, Zea mays
ctctcccactcgccttcctcaccgcagctctcccggctcggtcgacttcgccacctccgtcctccccccgcgctcggtcgctcgccacctgctctcccctccctccacgttgctcgcgcccgcgcttatataagtgcaggaggagctcatggcggacgctccggcgagccctgagggcggaggcgggagccacgagcttccggagccccaggggcgccggaggtggaccggtggcagcgtcagggagc

SEQ ID NO: 721 - DNA, 255 bp, Zea mays
ataggacactttggatatgaagaagagattgatcagctggaagagggataaacaagctcttgatggctgaggtagtgaaactgaggcaggagcaccaaaatactagatcagatctacaggccatggaagagaaattacgagacaccgaagcagaagcagcagcagatgatggcattcatggcacgagtcatgcagaaccctgatttcatgcgtcactagatctcccagcgggagatgaggaaggactcgaggatc

SEQ ID NO: 722 - DNA, 169 bp, Zea mays
gcaaaaggaacataaggatagaggagagaaataaacaatggggaagggagatgtggctaccaggtcaaaatctcaaaaatcaccagcaatacagaatgagcaagtacacctgctaacccgcccacagcatatcctgattggtctcagttccaggcatactataatgctg

SEQ ID NO: 723 - DNA, 207 bp, Zea mays
ccttctcctcggctgacctggtggtgtttgctgagctgttttggaacccaggggtgctgatccaggctgaggaccgcgtgcaccgcattcgacagaccagcttctcccgtgctcactacctcgtggcaacgggcacagctgatgactacctttggcccctgattcaagagaagattaaagttctggcagaagccgggctttctgaga

SEQ ID NO: 724 - DNA, 274 bp, Zea mays
acgagatggtggacgacccgtcgagcgacgcggtggtgtcatggagcgacgcatccgacgggagcttcgtcgtctggaaccagcccgagttcgccgcgcggatgctgcctacctacttcaagcacaacaacttctccagcttcatccgcagctcaacacatacggttttcgcaaaatagacccagagcgctgggaatttgctaatgagtactttgtcaagggacagacgcacctgatgacgaatatccacaggtggttatccatccacagccat

SEQ ID NO: 725 - DNA, 260 bp, Zea mays
cgatgatatgatttcctgatctggtgtgcttgcagggatggtgaagcttcaaagttgactgaaaatggcttccaatttcttctgatggaacaaatgcacaactttggtacataatgagagaatacatttcatctgctgaggaacgtggagtggaccctacggagctgatatcatttctcttggaacttagctttcataaattgggagcggtaaagtgatagtactttcagaacatcacgttaagcaagtagctatacata

SEQ ID NO: 726 - DNA, 200 bp, Zea mays
ccccaacgtcgcgccgctctccaagtgccgactccgcctcctcaagctcgaccgggtcaaggactacctcctcatggaggaggagttcgtacgccgttcaggagcgcctccgcccccaggaggacaaggccgaggaggaccgatccaaggtcgacgacctccgaggcacccccatgagcgtcggatccctcgaggagatc

SEQ ID NO: 727 - DNA, 308 bp, Zea mays
  unsure (1)..(308): unsure at all n locations
gataatttaatngagatgaactcaagataaccaaactggcgctgtccatattgtaacacctcctcaagcttcactgacctacgtattgaccaaaagatgatgaagatactagaagagactggagatgatgtcactgatgtccttgtatttggtgatgatttatggaaagttgttccagctcaggatgaaaaatctgatagacatagaggtgacacaattcagcaggctggagatgctgtagaaactggttcacttctcgagatgtcatagatctgataaatggcaatgatgatggtagatatgaaatg

SEQ ID NO: 728 - DNA, 289 bp, Zea mays
ggcagatcaaggtctggttccagatccgcagatgccgggagaagcagcggagggagtcctctcgtctgcagaccgtcaaccggaagctgggtgccatgaacaagctgttgatggaggagaacgaccggctgcagaagcaggtgtcccgtctcgtcttcgacaacgggtatatgaagaatcggctaccacagtccttctgtagccaccaccgacacaagctgcgagtctgtggtgacaagtggtcagcacaagcagcagcaaaacccagcagttctgcatcctccacaaa

SEQ ID NO: 729 - DNA, 306 bp, Zea mays
  unsure (1)..(306): unsure at all n locations
gaaaaaatggcgacttgaaatctgtcaatgatcttgcaaaggaaggagcgcgtaaaaatgacaggcttgttgctaatttagctaaccaaattgaggtgaacaataggtatttacaggaactagaatgcaaatacagtgagacaactgcatcacttgagaagtattngggcaaagggaccaacttctccagtcatacaatgacgaaattagcaagatgcagcagctagctcgcaggcattctcagaagatcattgtgagtaatcaaagctgcgttctgaccttgaggtcaagatgaatgatcttgat

SEQ ID NO: 730 - DNA, 313 bp, Zea mays
acctaatgttgcacatgctgtggccaccaaaagtgtgttccacatctactacaaccccagattaagccaatctgaattcattataccattttcgaagtttatcaagagcttcagtcaaccattttctgctggttcgaggttcaaagtgaaatatgagagtgatgatgcttctgaaagaagatgcacagggatcatagcaggaattggtgatgctgaccccatgtggcgtggttcgaaatggaaatgtttgatggttcgatgggatgacgatgtagattttcgtcaaccaaacaggattctccttgggagattg

SEQ ID NO: 731 - DNA, 303 bp, Zea mays
gcaatagcatccacctattattcacacttagagccttttatggaaaccatattctacctgacagctaatgcagttaaaggtgatgaggaaccggttgcacttcaagctgttgagttctggagcgctatctgtgacgaagagattgcactccaagatgaatatgagggatctgaggatggtaactctgctatacacttccgctttattgaaaaggccctccctttacttgttccgttgctgctagaaactttgttgaagcaagaggaagatcaagatcaagatgataatgcttggaatatttct

SEQ ID NO: 732 - DNA, 290 bp, Zea mays
gtgtatcaaaattgacggcaagacacctttaactacaagacaaaccttagtcacagatttccaaaacaatgatgacgtcaaggcagcagtgttatccatcaaagccggaggtaccgggataactttgacagcagcgagcacggtaatctttgccgagttatcatggactcctggggacatcattcaagctgaagatcgcgcgcacaggatcggtcaggtctcgtccgtgaacgtgtattatcttcctgcgaacggtactatagatgatcttatgtgggacgttgttcagg

SEQ ID NO: 733 - DNA, 292 bp, Zea mays
  unsure (1)..(292): unsure at all n locations
agcgaaatgagaacagcaggaggagaatagtagctgcgaacaagaaaaggcggctgcccaagcaagatggtggactcgagtccgaaagttctgctgcttcgttagacggtcaaattatcaagtatcagccttcgatcaacgaagcagccaaagcaatgctaaggaagatcctaaacgtagattcttcgcataggtttgaatctatgggcanttcagnnnnnnnnnnnnnnnnnnnnnnnctgctggaggattatatgccggccgcccaagcttttgagagctcttcgtcgac

SEQ ID NO: 734 - DNA, 291 bp, Zea mays
ctatttcaataccttgccgctgtatttgcaactgatttacactctagagcttttctgcgccttccaaaaactcttggagtggacttccgtgcttcgtgtttctgccataagaagactattgacatgggatatgtctgttcaatttgtttgtcaatattctgcaagaatcagaagaagtgttcaacctgcgggtcagaattcagtcgtgccatgcctgatttgaactccgtgccggatcaaagcaagtagtgtccagtgcgaagttaacccatcacagacaatgcttttctc

SEQ ID NO: 735 - DNA, 273 bp, Zea mays
agaagcttcaatcaaccaatttctgttataatgaggtgcagaatgcgatatgaaagtgacgatgcttctgaaagaaggtgcactggtataataattggaagcagagaagctgatcctatatggtatggttcgaaatggaaatgcttggtggttagatgggatgatggtatagagtgccgttggcccaatagggtatctccttgggagattgagctcacaggatctgtttcaggatctcaaatgtgcgctcccagttcaaaacgtctgaaacca

SEQ ID NO: 736 - DNA, 262 bp, Zea mays
ggagaaaattacatttgtcccttctgtagcagcaagaagaagaattacagtaaaagtagcctggttcaacatgcctcaggagtcagtgcagcacctaatcgggaggcaaaagaaaaagcagtccatcgcgccctcttcaaatatttgaagaatggtcttgctaaatcacctgaaccagggtcacatgcaactcctgtggagccacaacctcttcagaaccgagacgagaagtttgtgtggccctggatgggtgtcctagtta

SEQ ID NO: 737 - DNA, 351 bp, Zea mays
  unsure (1)..(351): unsure at all n locations
cgcataaccaatcttgccatcaatatgttcagtgtgatatctgtggtacgaaacagctaaagaagaatttccagcgccatcatcggatgcatgaaggttcctgcgtcactgagagggttanatgccacatcgaggactgcaaatgttcgttctcgaagaaatccaatttggacaagcatgttaaggcggtacatgagcagcgtcgtccttttgtgtgccaattctctgggtgtggcaagaggttttcttacaagcacgtaagggacaatcatgagaagtcaagcgctcatgtgcacactgagggtgattgtgtcgaggctgatgagcagcggccagttcagtaggtgggtg

SEQ ID NO: 738 - DNA, 346 bp, Zea mays
agcttggggagatgtggcaaaagatgtcaggcgaagagaaacagccttacatccagcaggcccaggtcgacaagaaacgttatgaaaaagaaccgctgtctatcgcggtgaagctacagtcgatgtggattctgggaacgagtctgactagagatccaagctcttgggctggcatggtggcacgggatgaaagtctagtgccatgtgtgctattgttatgtcagcaaccgttgcctccaacattgctgacagtaaagagagtttctctcgcagcttacctctgcagggcaaaagaatgtacgagtgtagtctagtgattttgtgctaaacaaccaactacgtggtt

SEQ ID NO: 739 - DNA, 308 bp, Zea mays
cgacgacgccgccaggagttccatggagcgaggaggagcacaggcagttccttgccggcctggagaagctgggcaagggcgactggcgaggcatcgccaggagctacgtgccgacgaggaccccgacgcaggtcgccagccacgcgcagaagttcttcctccggcagagcagcatggccgagaagaagaacgccgctccagcctcttcgacatggtccgatctgcgagacagtcgacatctccgatctctggagtggcagcatgggtcgctcggcagctccgagaggcgccgtggactgatgattcga

SEQ ID NO: 740 - DNA, 339 bp, Zea mays
cgacgacgccgccaggagttccatggagcgaggaggagcacaggcagttccttgccggcctggagaagctgggcaagggcgactggcgaggcatcgccaggagctacgtgccgacgaggaccccgacgcaggtcgccagccacgcgcagaagttcttcctccggcagagcagcatggcgggaagaagaagcgccgctccagcctcttcgacatggtgccgatctgcgagaacagtgcgagcatctccgatcctctggacgtggcacgccatggcgtcgcctcggcagactccgagagggcggccgtggacctgatgaattcgacgacggacggtgacga

SEQ ID NO: 741 - DNA, 267 bp, Zea mays
gttaccatttgctcccagcactgagcttaaccgagcttcacaaagatgaatcgggaaaaattgatgaagatggccggttcggttagaactgggggaaaaggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtgattatccagtttctaaatcccaaagttcaa

SEQ ID NO: 742 - DNA, 253 bp, Zea mays
caatgaacctatgatgggatcaaacagattgacaccaatggctcctcatggatgctttcccgcatatttacctgttccttttcccgtgtggccatcaacttgggttcacccctttgaagaagttaagggaggagagacatgccaccatcagatccacaagccaatcccagtcattccaaaggaacctgttaatgttgacgaacttgtgggaatgtctcatctaagcattggggaagcacaggtacgtgataga

SEQ ID NO: 743 - DNA, 211 bp, Zea mays
aaatttaagcagcaccctgctgtatgaaaacttttggaaggtggaacagctattcagtatggtgcacgtactctcaatgaaggtggtttccagtcaataccatatccaattttccctggaggtgcaattattggatgctctgcaggatttctaaatgttctcaaaataaaaggaacccatacagctatgaaatcatgtatgcttgcggcgg

SEQ ID NO: 744 - DNA, 261 bp, Zea mays
gaactacaacttaggcctcaacaggacaggaaagagctgccgcctgcgctgggtgaactatcttcaccctggcctcaagcatggccgcatgtcaccacaagaagagcgcattatcattgagctccatgctcggtgggggaacaggtggtctaggatagcaaggaggctgccagggcgcacagacaatgagatcaagaactactggagaacacacatgagaaagaaggcacaggagaggaagatgggcatgccatcaccttc

SEQ ID NO: 745 - DNA, 270 bp, Zea mays
aaaagtcaaggctgttcaagaaaaagtccaatcaatgcgcaaagctgtcatagctaatttcaaatcaatgcttcgagaaagtaaagatataacttcaactagccgatgggcaaaagttaaagaaaatttccgtagtgatccaaggtacaaagccatgaagcatgaagaaagggagactatatttaatgaatacatagtggaactaaaatctgctgaacaggaagcagagcaagctgccaaggccaaagtggatgagctagccaagttaaa

SEQ ID NO: 746 - DNA, 262 bp, Zea mays
cctcttcaacttcatcagcggtaagcatttgaaaattctgaatcttggagatggacaaggtagaactagtggtgttactgctgttcttcagagcactgatgatgattctgttgatccacatctggagcggataaaaaatcaggccggtaatgaggaaagtgatgaagaggatgaagattttgtggcagacaaggatgatagtggatctccaaccgatgattctgatgcagaaggctctgatgctagtatgagtggaggagaa

SEQ ID NO: 747 - DNA, 275 bp, Zea mays
acagcaacagcaaacaactgaccatcagctgcagactttgggcaagcgtcttcaagggatggagtcacggcagcaacagatgatgtctttcctggctaaagcaatgcaaagtcctggtttcctagcgcagtttgtacagcaaaatgagaagagcagaagaagaatagtagcggcgaacaagaaaaggcggctgcccaggcaagatggtggcctagactccgaaagtgctgctgcttcgttggacggtcaaatcatcaagtatcagcctctgatca

SEQ ID NO: 748 - DNA, 320 bp, Zea mays
ccttgaagaggtgacaattacttttattagacattgctatggacaagtgcagttcgtggaggagtttgccaggtgccatgctacaagcctgacaaagttagggcatctttggttcgtggctaactgtgccacactttgcctaaggttagtcgttcacattgaagaactaaccttaggcagacaagttcaggcaagtgtggcaagttaggtagcgaaccatacaggcccgtagtcgtcaactcagcaaccagagggctacaagagatggtcggcggattgtttgatccggatgtcactgtcaaatgcaatgttatctagcg

SEQ ID NO: 749 - DNA, 187 bp, Zea mays
  unsure (1)..(187): unsure at all n locations
ntactaattatgactattactccgcgaacgtatctcggaatactgctcgagggcaggcaagtctacctgggggcgtatgacagcgaggaggcagctgctcgagcctatgacctcgcagctctcaagtactggggtcctgagactctgctcaactaccctgtggaggattactccagcgagatgctgg

SEQ ID NO: 750 - DNA, 292 bp, Zea mays
atgattacttcgagtattttggaccagacttcagactgcatattagtcgctcaaacatgacaagccagaacactccagaatatatggaggagataaacagcgtttatttgaaatctgcgatgttacacatgcgctggtgttcaatgaagctatccgaagatgctgtcatgaagcagtggtatgggatgggaagacctacagagattctatcggcacaacaacggtactttgagaaatccagatctgagagagtgagagctagatgcgtgcaagaagacaaaacggatagagc

SEQ ID NO: 751 - DNA, 317 bp, Zea mays
acagattttatgaaaagctttatgcactactgactccggctgttttcatggcaaaacaccgatcagtgtttttgcaacttcttgacacatgcctgaaatcttcttatcttcctgcctatcttgctgctgcgtttgcaaaaagattgagtagacttgctctttcagttcctccagctggagctcttattattattgctttaattcataatctgctgaggagacacccctcagttaattttttggtccattgggaggttgatgagagtgatagcaatgccacaagagaagctagtcaatctaagaagattggttctgat

SEQ ID NO: 752 - DNA, 362 bp, Zea mays
caatgatcaattgttctttccaggagttccaactgaagattataatacgcctggagaatctgctgagtatcgagctcctacacctgctggtgggacaaccagatccaggaatggatgctgaagatgttaatgatggtgacggatgatgatgatgaacttcgtcttaatgaagacgacgacgacgacgatgatttagatgaccttgaggaaggggaggatgaacctaacacacaacatcttgtacttgcacaatttgacaaagtgacgaggaccaagaatcgttggaagtgcactttgaacgatggaatcatgcatttgaatggtagggatgttctatttaacaaggcgacaggcgagtatga

SEQ ID NO: 753 - DNA, 349 bp, Zea mays
tgcaaggcagatctagggcgatcatggcttacgtcgagagaggtgttggaaggtctcgtttatctgcatgaacaaggtgtcattcatagagatatcaagggcgcaaatatactgagtaccaaagagggtcttggcaaacttgctgattttggagttgccactaaattgactgaagctgacatcaacactcattttgtggtcggcactccatactggatggcgcctgaggtcggctattgactaaccatttgttgaatatgatgtttctactgcagagaatgtaccatgaatcacatgaatttggtggtcatatgttcaacactctcctagagggtgttctcgacaaaga

SEQ ID NO: 754 - DNA, 190 bp, Zea mays
tctggatcaggcctcgaagtagttatactatatggggaactggaacagcgtgaactctactcgcaaaggctgttgccaattctacttcagcaacgttctcgcgtgttgttgggagtgaattgatccaacagtaccttagtgatggtcgcaagcttgttagagaattgttcaggtggctgatgatctttct

SEQ ID NO: 755 - DNA, 237 bp, Zea mays
agcaagctaaaacttgcaagcctggagcaagaactccagaaagctcgacaacagggaatcttcatatccagttctggagatcaaactcatgctatgagtggaaatggagctatgaccttcgatttagaatattctcgatggcaggaggaagaaataaggacgtcaatgggctgaggactgcagtaaatgctcatgcaagtgaacgtgacctccgtcttatcgtcgatgggataatgg

SEQ ID NO: 756 - DNA, 238 bp, Zea mays
agattctgagattgatgattatgaaggaaaaatttatgcaagactgatgtcaggagatttaaaattaaataagaatggagaaaattacatttgtcccttctgtagcagcaagaagaagaattacagtaaaagtagcctggttcaacatgcctcaggagtcagtgcagcacctaatcgggagtaaaagaaaagcatcatcgcgcctcttcaaatatttgaagaatggtctgtaaatcac

SEQ ID NO: 757 - DNA, 251 bp, Zea mays
cttctggtacaggtgtatgtaattttgaagtaacataggatttggaacccagccctctgttctccaccaccgcttcgaagttgccgcagtaatggtggtggcacggaacttcatggatatggtggctgctcttcctgcgggcaagcttgatatgctctatgactcagcctttatctgtgaggcagtactcaggtcacttcccccactggcaaagaagtatgcactgcagatgttgtatgtgctggcaccag

SEQ ID NO: 758 - DNA, 272 bp, Zea mays
gtagactcaggttattgggcctagcccattacacaatggtaaaaatgtaattacaaggggctaaccccaaaaccctaaatgggtagtctaacagccgcagtcacaactctatactgtacaaatgttgagactggatcgaaaattggtgaatacactcgacggtagcccctaggtgatgtcggcgaactgcaacgaggtggggacactgacaacctgagtgtcaccagcaactacacgctcgtggataaagtgtaggacgctctccacgtgct

SEQ ID NO: 759 - DNA, 261 bp, Zea mays
gtatcgtcatatatataggggtcagcctcgtaggcatctcttgactactgggtggagctcatttgtcaacaaatagaaactgggttcaggcgatgctgcgtcatttctccgaggtgatgacggtgaactaaggctgcgtgtgcggagggctattcagcttaaaaatgaggccctttttgaagatttcaatagtgacagcacaaagcggcattctttgacgtgtgtagctgattccttgaagaacagaagtgtttttcacat

SEQ ID NO: 760 - DNA, 289 bp, Zea mays
  unsure (1)..(289): unsure at all n locations
gtaattggcgtggangatgccgatacgtagctcgaattcgctcgagtgctatagacataagacaagacatactggaaagatatggcgaatgtgaacatgagaagttacagttgagaaaaggctccgcaagtgtagatgagcataaggcgcgcaaagaaggatataatgagctaaaccagtggttgacaactacgcagagcaaaatattgccatgtgataaatatgtgaaagtctttcataaacttttaactgcatatagacatatgacatgacatactggaaagaaacc

SEQ ID NO: 761 - DNA, 200 bp, Zea mays
ctgccgtggtggaggatgaaaagaaacctgaagatgcaccacagtctgaggttgagaaggacaaggagggcgcggagaatgaagaagaaaaggaacctgaggataaggagatgactttggaggaatatgaaaaggtactggaggaaaaacgaaaagctttactctcccttaaggctgaggagagaaaagttgaaattgac

SEQ ID NO: 762 - DNA, 263 bp, Zea mays
caaggatctgtatccctacgccttaaggctcatcccgaatacttacgccaaggaagaagacctgaagaatctgtgcacaccttaggaagctttacttttttttccccttctgttatataaatcggaattagatttgtcaaagagtgagtgaagttgttcctggatgtgaccgactgtactgagcaatgtgtcgtcgccggcgcgcttaactttgtggatggaccaatgagaacagaagttatcatcatcagatcgaattcttt

SEQ ID NO: 763 - DNA, 300 bp, Zea mays
tctcaattgcagccagctgcatttacatgataacccaactctcagaggacaagaagccacttaaaggatatatccttggctacttggtgtggcagaagggccccatcaggaaatccgtacagggatctgtatccctacgcgtcaaggctcatcccgaatacctacgccaaggaagaagacctgaagaatctctgcacaccttaggaagctttactttttttcccttctggtatataaatcggaattagagttgtcaaagaggagtgagtgaagttgatcctagtgtgaccgactgtactg

SEQ ID NO: 764 - DNA, 257 bp, Zea mays
tgtcaattgcagccagcggcattgacattataacccaagtctcagaggacaagaagccacttaaagatatatcctaggctactgctgtggcataaggcaccatcagaaattcgtacagggatctgtatccctacgcctcaaggctcatgccgaatacctacgccatggaagaagacctgaagaatctctgcacaccttatgaagctttactacatctcgcttctgttatatgcatcggaattagatttgtcatagac

SEQ ID NO: 765 - DNA, 261 bp, Zea mays
ctcctgacagaggattttctttatcttatacgcaaggatttacggaaactgcaccgtgctactgaactactgtccatgaatgaagagctcaagcaagcaaggaaagcttttgacgtggatgaagagacgctggctacgactaacatatgatgtcttcctagtcggagaatctgcgtgttactgtaaccagttgtacaatgcactgcatgtgtctgacaattggtggcgtcgacttgtaactgttccgtacagactttagct

SEQ ID NO: 766 - DNA, 313 bp, Zea mays
  unsure (1)..(313): unsure at all n locations
tctggcatgccctctagctcgaatcgctcaggtacctgcgacatctcgcggaactttgagatctcaaggacgccgactcaagtagctagtcatgcacagaagtactttatccgactgaactcaatgaacagaggaaaggcggcgatcaagtatacatgacatcaccagtgtgaacaatggagatccatctactgcacagggtccaatcacaggccanacaaatggtcaggctgcaaatcctggaaaaccatctaagcaatccccgcagccagcgaatacacctccanggcgtcgatgcttatggcacaacaat

SEQ ID NO: 767 - DNA, 263 bp, Zea mays
tcaaccgccactgcctcctgctgtggaggaggaggcggaatcgatggagtcagatacttctgctgtcgcagagagctctggagcttctgctctcatgcccgagagtttacagcctacctatccgatgattgttccagcttatttctcgccgttcttgcaattctcagttcctttctggccaaatcaggaagatggaggcgatcttccccaagaaacacacgagattgtcaagcctgtggcagttcattcccagaatccaatta

SEQ ID NO: 768 - DNA, 254 bp, Zea mays
gtcgaaacaagtcagcgttcagattctgttttggtgctgcgacaccgtctgttgggccgttgggccgtgtatcgcgtcggaggccattaggggcgagtccaggggtcacgcacgccctaatacactatttattcagccgccgccgccacatttaggcttgggttttgcttagattaattctatcctcgaacagtatcgccgacatcggtttgtgagaccccatctcgtaatcaatacaattttggttgtgtttc

SEQ ID NO: 769 - DNA, 254 bp, Zea mays
gtgcaagtcctgcagacagaggctacgacactctcagcacagttgacaatgctgcagagggactcagctggactggctactcagaacaacgagttgaaaattaggctgcaagccatggagcaacaagcacagctgagagatgccctgaatgaagcgttaacgggcgaggtccagcgtctgaaactcgcaactggggagatgaccgatgggcctatgccgaagggcctgcagcagcagatgaactcccagatgct

SEQ ID NO: 770 - DNA, 307 bp, Zea mays
gctgacagacgctcggaagctcggcacgaggctgctcaagatcctgataccgcagctggacccgctgacggagcagcagctgctggggatctgcaatctgcagcagtcgtcggagcaagcggaggaagctctcgcccagggcctgcaccagctgcaccagtccacggccgacacagtcgccgcgggcacgctcaacgacggcgccgccgcccccaagcgcatgaacatcatggccgtcgcacttgagaagctcgccagcctcgaaaatttctatcaacaggccgacaatctaaggcaccagacgttg

SEQ ID NO: 771 - DNA, 231 bp, Zea mays
gacgaggagaagctcatcatccacctccactccctcctcggcaacaagtggtccgccatcgccaccaagctgcccggccggaccgacaacgagatcaagaactactggaacacgcacctccgcaagaagctgctcgccatggggatcgaccccgtcacgcaccagcgccgcaccgacctcaaccttctcgcggccggcggcttcaccaacctcctcgccgccgccaacctc

SEQ ID NO: 772 - DNA, 250 bp, Zea mays
gcaagtaacaatgaagcagctgagactgagagatactagtgcttcccttgctttgactaaatcaactcgcagcctgtgagttccatggagcgaggaggagcacaggcagttccttgccggcctggacaagctgggcaagggcgactggcgaggcatcgccaggagctacgtgctgacgaggctcccgacgcaggtcgccagccacgcgcagaagttcttcctccggcagagcagcatggggaagaagaag

SEQ ID NO: 773 - DNA, 251 bp, Zea mays
gcactatttgagaggtttgggcgttccactggggcccacaaggcaaaatacaggtcaatcatgttcaacctgagggctgaaaacaacactgattttcggagaagggttctcattggtcaagtgaccccagagaggcttccagacatatcccctgatgagatggctagtgatgcaaggaagcaagagaatgagcagatcaaggagaaggctctgtttgactgtgagcggggagcagcaccaaaggcaacaac

SEQ ID NO: 774 - DNA, 259 bp, Zea mays
aaaatctgttttctgctgcatgcgcacaaatttagcatgacaaaaatgtgcgttgaaagaaattggagcgccttgcatggaaacaaaaatatgattttaatgctttattcctccataaatataggacctctccaacaatcacgcagttagattatgctacacagtgaaggcgtttatgcactgtggttaggctgtttagaatcagttcctatttttacggagcgcaggcttgcggtttctattttgatgtagatcccaa

SEQ ID NO: 775 - DNA, 260 bp, Zea mays
ggcaataatcgaggatgatgcaaagcttcgagcactcaaagaagaacatggagaagaaatctatgcaatggtgacaaaggcgctgcttgaaaccaacgagtacaaatcaaaaggcagctaccctgtgggggagctatggaacttcaaagaaaaccggaaggtgactctgaaggaagctgtccagtttgtcctgagacagtggcgaacaaacaggaggaagcgataagctctcggccacccaatgctcttggctttttttc

SEQ ID NO: 776 - DNA, 287 bp, Zea mays
ggaagtggaaagaagtgggttcttgcttgagctgagctcttgctgcccttggatctggttgggagtggagaacgcagtatggaggcgaggcaagatcaagatcaagaggatcaagaactctaccaaccggcaggtgaccttctccaagcgccgggccggactggtcaagaaggcacgggagatcggagtgatctgcgacaccgaggtcggcgtcgtcatcttctccagcggcggcaagctctacgactactgctcgcgcaggacctcgctgtccaggatcttggaga

SEQ ID NO: 777 - DNA, 317 bp, Zea mays
  unsure (1)..(317): unsure at all n locations
cggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaacgngtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgc

SEQ ID NO: 778 - DNA, 298 bp, Zea mays
  unsure (1)..(298): unsure at all n locations
cccacgcgtccgcgagagcggnagccccaggggcggcggaggtggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatatt

SEQ ID NO: 779 - DNA, 435 bp, Zea mays
cccacgcgtccgggcttgctgagctggagctgatggatctagggtttgggttgcggtgatggtcctgcagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacggaag

SEQ ID NO: 780 - DNA, 227 bp, Zea mays
gcacgaggagactcgtcccccgtaccgtggcggaggcagacgtggtggttacaggaatgttgagtttgctgatgactctgagaggccaccacggagaaactatgagcgccacagcgggactggccatggctatgagatgaagcgtgatggcgcagggcgtgggaactggggcactgccactgatgaacttattgcccaggatgcagaggactctccgaagatggagg

SEQ ID NO: 781 - DNA, 274 bp, Zea mays
atggcaatgagttccagggaggttatggtggcggaggctatggggatggtgctgtaactggtggatctgatggagaaagggagagagagactcgtcccccgtaccgtggcggaggcagacgtggtggttacaggaatgttgagtttgctgatgactctgagaggccaccacggagaaactatgagcgccacagcgggactggccatggctatgagatgaagcgtgatggcgcagggcgtgggaactggggcactgccactgatgaacttattgc

SEQ ID NO: 782 - DNA, 255 bp, Zea mays
agcgtgatgagcgtgccaagaagtcggtgagcatcaacgagttccttaaacctgctgaaggagaaaggtactacggcggccgtggccgtggaaggggccgtggggatcgtggtggttttagaggcggataccgagggggatacagtcgtggcccagctgctgctgctccatccattgaagatcaagctcagttcccaagccttggtgggaagtgaagggcgcccagctgctgctgtcaccgagcgttgtgttgtc

SEQ ID NO: 783 - DNA, 320 bp, Zea mays
aggaggaagaaaatgaagaggacaaggagatgactctggaggaatttgagaaaataagataggagaagaggaaagcagtacttggaatggaggctgaggagaggaaagttgaagttgacaagggattgcagtctctgcagccactttcagacaagaaagaaaatgatggagttttcattaagctgggttctgacaaggataagaagaaggagaatgctgagcgtgatgagcgtgccaagaagtcggtgagcatcgacgagttcctgaaacctgctgaaggagcaaggtactatggcggccgtggccgtggaaggggccgt

SEQ ID NO: 784 - DNA, 296 bp, Zea mays
cccacgcgtccggaagaggaaagcactacttgcattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactatggcggccgtggccgtggaaggggccgtggggagcgtggtggttttagaggcggat

SEQ ID NO: 785 - DNA, 309 bp, Zea mays
cccacgcgtccgcagaatgttgagtttggtgatgactctgagaggccaccacggagaaactatgagcgccacagcgggactggccatggctatgagatgaagcgtgatggcgcagggcgagggaactggggcactgccactgatgaacttattgcccaggatgcagaggactctccgaagatggaggaggctgctcctgttgctgagaaacaaggtgagcagaatgatgccccagcagcagatgagaacaaagataacaaggatgctactgcaaatgaggaggaagaaaaggaagaggacaaggagatg

SEQ ID NO: 786 - DNA, 234 bp, Zea mays
gcgcccttcacttcccaccaaggcttgggaactgagcttgatcttcaatggatggagcagcagcagctgggccacgactgtctccccctccgtatccggctctaaaaccaccacgatccccacggcccccccttccacggccacggccgccgtagtacctttctccttcagcaggtttcaggaactcgttgatgctcaccgacttcttggcacgctcatcacgctcagcatttt

SEQ ID NO: 787 - DNA, 320 bp, Zea mays
cggacgcgtgggcggacgcgtggggttctgacaaggataagaagaaggaaaatgctgagcgtgatgagcgtgccaagaagtcggtgagcatcaacgagttactgaaacctgctgcaggagaaaggtactatggcggccgtggccgtggaaggggccgtggggagcgtggtggttttagaggcggatacggagggggatacagtcgtggcccagctgctgctgctccatccattgaagatcaagctcagttcccaagccttggtgggaagtgaagggcgcccagctgctgctgtcaccgagcgttgtgttgtctgctgttg

SEQ ID NO: 788 - DNA, 307 bp, Zea mays
cccgtaccgtggcggaggcagacgtggtggttacaggaatgttgagtttgctgatgactctgagaggccaccacggagaaactatgagcgccacagcgggactggccatggctatgagatgaagcgtgatggcgcagggcgtgggaactggggcactgccactgatgaacttattgcccaggatgcagaggactccccgaagatggaggaggctgctcctgttgctgagaaacaaggtgagcagaatgatgccccagcagcagatgagaacaaagataacaaggatgctactgcaaatgaggaggaa

SEQ ID NO: 789 - DNA, 312 bp, Zea mays
cccacgcgtccgggccgtggcagaggtggacggggatatggccagaaccgtggcttcagtggtgacaatggcagtgacttccagggaggttatggtggcggaggctatggggatggtgctgtaactggtggatctgaaggagaaagggagagagacactcgtcccccgtaccgtggcggaggcagacgtggtggttacaggaatgttgagtttgctgatgactctgagaggccaccacggagaaactatgagcgccacagcgggactggccatggctatgagatgaagcgtgatggcgcagggcgtgggaac

SEQ ID NO: 790 - DNA, 225 bp, Zea mays
ggaggaagaaaaggaagaggacaaggagatgactctggaggaatttgagaaaataagagaggagaagaggaaagcactacttgcattgaaggctgaggagaggaaagttgaagttgacaaggatttgcagtctctgcagccactttcaaacaagagagagaatgatgaagttttcattaagctgggttctgacaaggataagaagaaggaaaatgctgagcgtga

SEQ ID NO: 791 - DNA, 241 bp, Zea mays
cggacggtgggcggacgcgtgggtggatctgaaggagaaagggagagagacactcgtcccccgtaccgtggcggaggcagacgtcgtggttacaggaatgttgagtttgctgatgactctgagaggccaccacggagaaactatgagcgccacagcgggactggccatggctatgagatgaagcgtgatggcgcagggcgtgggaactggggcactgccactgatgaacttattgcccagg

SEQ ID NO: 792 - DNA, 251 bp, Zea mays
gggaggttatggtggcggaggctatggggatggtgctgtaactggtggatctgacggagaaagggagagagacactcgtcccccgtaccgtggcggaggcagacgtggtggttacaggaatgttgagtttggtgatgactctgagaggccaccacggagaaactatgagcgccacagcgggactggccatggctatgagatgaagcgtgatggcgcagggcgagggaactggggcactgccactgatgaac

SEQ ID NO: 793 - DNA, 240 bp, Zea mays
agaaaagaagaggacaaggagatgactctggaggaatttgagaaaataagagaggagaagaggaaagcactacttgcattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaagtcggtg

SEQ ID NO: 794 - DNA, 216 bp, Zea mays
ggacgcgtggaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtcgaagggggggccgtggggatcgtggtggttttagaggcggatacggaggggg

SEQ ID NO: 795 - DNA, 278 bp, Zea mays
tatgagtaagggagagagacactcgtcccccgtaccgtggcggaggcagacgtgactggttacaggaatgttgagtttgctgatgactctgagaggccaccacggagaaactatgagcgccacagcgggactggccatggctatgagatgaagcgtgatggtgcagggcgagggaactggggtatgccactgatgaacttattgcccaggatgcagaggactctccgaagatggaggaggctgctcctgttgctgagaaacaaggtgagcagaatgat

SEQ ID NO: 796 - DNA, 269 bp, Zea mays
  unsure (1)..(269): unsure at all n locations
ggataagaagaaggaaaatgctgagcgtgatgagcgtgccaagaagtcggtgagcatcaacgagttcctgaaacctgctgaaggagaaaggtactatggcggccgtggccgtggaaggggccgtggggagcgtggtggttttagaggcggatacngagggggatacagtcgtggcccagctgctgctgctccatccattgaagatcaagctcagttcccaagccttggtgggaagtgaagggcgcccagctgctgctgtcaccgagcgt

SEQ ID NO: 797 - DNA, 265 bp, Zea mays
cccacgcgtccgcccacgcgtccggaggaaagcactacttgcgttgaaggctgaggagaggaaagttgaagttgacaaggatctgcgttctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgt

SEQ ID NO: 798 - DNA, 121 bp, Zea mays
tactgcaaatgacgaggaagacaaggaagaggacaaggagatgactctggaggaatttgagaaaataagagaggagaagaggaaagcactacttgcattgaaggctgaggagaggaaagtt

SEQ ID NO: 799 - DNA, 274 bp, Zea mays
atggggatggtgctgtaactggtggatctgacggagaaagggagagagacactcgtcccccgtaccgtggcggaggcagacgtggtggttacaggaatgttgagtttgctgatgactctgagaggccaccacggagaaactatgagcgccacagcgggactggccatggctatgagatgaagcgtgatggcgcagggcgtgggaactggggcactgccactgatgaacttattgcccaggatgcagaggactccccgaagatggaggaggctgc

SEQ ID NO: 800 - DNA, 284 bp, Zea mays
ggcaaaacggatccgtaacttcgggaaaaggaagaggacaaggagatgactctggaggaatttgagaaaataagagaggagaagaggaaagcactacttgagattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaagtcggtgagcatcaacgagttcctga

SEQ ID NO: 801 - DNA, 291 bp, Zea mays
ggataagaagaaggaaaatgctgagcgtgatgagcgtgccaagaagtcggtgagcatcaacgagttcctgaaacctgctgaaggagaaaggtactacggcggccgtggccgtggaaggggccgtggggatcgtggtggttttagaggcggatacggagggggatacagtcgtggcccagctgctgctgctccatccattgaagatcaagctcagttcccaagcctcggtgggaagtgaagggcgcccagctgctgctgtcaccgagcgttgtgttgtctgctgttgtcata

SEQ ID NO: 802 - DNA, 308 bp, Zea mays
aaggataagaagaaggaaaatgctgagcgtgatgagcgtgccaagaagtcggtgagcatcaacgagttcctgaaacctgctgaaggagaaaggtactatggcggccgtggccgtggaaggggccgtggggagcgtggtggttttagaggcggatacggagggggatacagtcgtggcccagctgctgctgctccatccattgaagatcaagctcagttcccaagccttggtgggaagtgaagggcgcccagctgctgctgtcaccgagcgttgtgttgtctgctgttgtcatatttaaattttgtccg

SEQ ID NO: 803 - DNA, 304 bp, Zea mays
caaggctgaggagaggaaagttgaagttgacaaggatctgcgttctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtggaagggggggccgtggggatcgtggtggttttagaggcggatacggagggggatacagtcgtggcccagctgctgctgctcca

SEQ ID NO: 804 - DNA, 289 bp, Zea mays
gaagaaaaggaagaggacaaggagatgactctggaggaatttgagaaaataagagaggagaagaggaaagcactacttgcgttgaaggctgaggagaggaaagttgaagttgacaaggatctgcgttctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacg

SEQ ID NO: 805 - DNA, 288 bp, Zea mays
gaggaaagcactacttgcattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactatggcggccgtggccgtggaaggggccgtggggagcgtggtggttttagaggcggatacggagg

SEQ ID NO: 806 - DNA, 257 bp, Zea mays
gaggaaagcactacttgcgttgaaggctgaggagaggaaagttgaagttgacaaggatctgcgttctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcagccgtggccgtggaaggggccgtgggg

SEQ ID NO: 807 - DNA, 285 bp, Zea mays
tgatgactctgagaggccaccacggagaaactatgagcgccacagcgggactggccatggctatgagatgaagcgtgatggcgcagggcgagggaactggggcactgccactgatgaacttattgcccaggatgcagaggactctccgaagatggaggaggctgctcctgttgctgagaaacaaggtgagcagaatgatgccccagcagcagatgagaacaaagataacaaggatgctactgcaaatgaggaggaagaaaaggaagaggacaaggagatgactct

SEQ ID NO: 808 - DNA, 349 bp, Zea mays
ggatgctactgcaaatgaggaggaagaacaggaagatgacaaggagatgactctggaggaatttgagaaaataagagaggagaagatgtaagcactacttgcattgaaggctgaggagaggaaagttgaagttgacaaggatttgcagtctctgcagccactttcaaacaagaaagacaatgatgaagttttcattaagctgggttctgacaaggataagaagaaggaaaatgctgagcgtgatgagcgtgccaagaagtcggtgagcatcaacgagttcctgaaacctgctgaatgagataggtactatggcggctgtggcgtgagaggggccgtgcggagcgttgtg

SEQ ID NO: 809 - DNA, 264 bp, Zea mays
gactctccgaagatggaggaggctgctcctgttgctgagaaacaaggtgagcagaatgatgccccagcagcagatgagaacaaagataacaaggatgctactgcaaatgaggaggaagaaaaggaagaggacaaggagatgactctggaggaatttgagaaaataagagaggagaagaggaaagcactacttgcattgaaggctgaggagaggaaagttgaagttgacaaggatttgcagtctctgcagccactttcaaacaag

SEQ ID NO: 810 - DNA, 381 bp, Zea mays
aacttctacggtcgcaggggcaggtacggaatacggcgtcggcccacgcgaccgtgaatttgctgatgactctgagaggccaccacggagaaactatgagcgccacagcgggactggccatggctatgagatgaagcgtgatggcgcagggcgtgggaactggggcactgccactgatgaacttattgcccaggatgcagaggactccccgaagatggaggaggctgctcctgttgctgagaaacaaggtgagcagaatgatgccccagcagcagatgagaacaaagataacaaggatgctactgcaaatgaggaggaagaaaaggaagaggacaaggagatgactctggaggaatttgagaaaataagagaggagaagag

SEQ ID NO: 811 - DNA, 384 bp, Zea mays
ttaccaggctcttactgcggtatcacatactaggtcgagccgcccgtcaaagccacttacaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtggaaggggccgtggggatcgtggtggttttagaggcggatacggagggggatacagtcgtggcccagctgctgctgctccatccattgaagatcaagctcagttcccaagcctcggtgggaagtgaagggcgcccagctgctgctgtcaccgagcgttgtgttg

SEQ ID NO: 812 - DNA, 448 bp, Zea mays
ggcttctcagtacggttcagtcagccaggcctggtccgagactaccgggtccagccacgcgtccgcagacacgtgggcggacgcgtgggcggacgcgtgggctctggaggaatttgagaaaataagagaggagaagaggaaagcactacttgcattgaaggctgaggagaggaaagttgaagttgacaaggatttgcagtctctgcagccactttcaaacaagaaagaaaatgatgaagttttcattaagctggttagtttccctgtaattaatgctttgataccttaagtttgctgagctttgcacgggttcttcgatgttcttttgttctcgtagggttctgacaaggataagaagaaggaaaatgctgagcgtgatgagcgtgccaagaagtcggtgagcatcaacgagttcctgaaacctgctgaaggagaaaggtactatggc

SEQ ID NO: 813 - DNA, 410 bp, Zea mays
ggacaaggagatgactctggaggaatttgagaaaataagagaggagaagaggagagcgactacttgcattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtggaaggggccgtggggatcgtggtggttttagaggcggatacggagggggatacagtcgtggcccagctgctgctgctccatccattgaagatcaagctcagttcccaagcctcggtggg

SEQ ID NO: 814 - DNA, 358 bp, Zea mays
atctgaaggagaaagggagagagacactcgtcccccgtaccgtggcggaggcagacgtggtggttacaggaatgttgagtttggtgatgactctgagaggccaccacggagaaactatgagcgccacagcgggactggccatggctatgagatgaagcgtgatggcgcagggcgagggaactggggcactgccactgatgaacttattgcccacgatgcataggactctccgaagatggaggaggctgctcctgttgctgacaaacaaggtgagcagaatgatgccccagcagcagatgagaacaaagataacaaggatgctactgcaaatgaggaagaagagaaggaagaggacaag

SEQ ID NO: 815 - DNA, 229 bp, Zea mays
cacaggttgaacgactcaaaggtgaaaacgcaacactgttccagcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgcca

SEQ ID NO: 816 - DNA, 273 bp, Zea mays
ctttgaatttgcatgtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggaca

SEQ ID NO: 817 - DNA, 277 bp, Zea mays
gcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcagtacacgagtacagaactcacagtaca

SEQ ID NO: 818 - DNA, 273 bp, Zea mays
gcaacactgttccagcaactttcagatgtcaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcagtacacgag

SEQ ID NO: 819 - DNA, 226 bp, Zea mays
  unsure (1)..(226): unsure at all n locations
gcaacactgttccagcaactttcagatgacaaccaacagttcagtactgcagtcacagacaacagaatcctcaaatccgatgtagaagcgttaagaattaaggtaaagatggcagaggatatggtagcgagaagtgctgtatcgtgtgagcctagagcgaccttgagacctggcaccaatacgtgaaancatcaaggatcagatgtagccaagcttatgcacatgt

SEQ ID NO: 820 - DNA, 275 bp, Zea mays
gcaacactgatccagcaactttcagatgccaaccaacagttcagtactgcagtcacagacaacagaatcctcaaatccgatgtagaagcgttaagcattaacgtcaagatggcagaagatatggtcacgagaactgctgtaacgtgtggcctacagcgacttgggctggcagcatacgtgaactcccggaaggtgtgccaagctttgaatgtgctcacagggttggatttactagggagtgatgcgttcagggtccaaccgcaggtacacgagta

SEQ ID NO: 821 - DNA, 253 bp, Zea mays
cgactcaaaggtgaaaacgcaacactgttccagcaactttcagatgccaaccaacaggtcagtactgcagtcacagacaacagaatcctcaaatccgatgtagaagcgttaagaattaaagtaaatatggcagaggatatggtaccgagaagtgctgtatcgtgtggcctaggcgaccttggcctggcaccatacgtgaactcaaggaaaatgtgccaagctttgaatgtgctcacagggttggattaactag

SEQ ID NO: 822 - DNA, 143 bp, Zea mays
cattgatgaagctcaccggataaaaaatgaaaattctcttctatcaaagactatgaggatttacaacactaattatcgtctcctcatcacaggcactccactccagaataatctccatgagctctgggctctcctcaatttct

SEQ ID NO: 823 - DNA, 411 bp, Zea mays
aaaaaatgaaaattctcttctatcaaagactatgaggatttacaacactaattatcgtgtcctcatcacaggcactccactccagaataatctccatgagctctgggctctcctcaatttcttgctacctgaaatatttagctctgcggagacctttgatgaatggtttcaaatatctggggaaaatgatcaacaggaggtggtgcagcagcttcataaggttcttcgcccattccttcttaggaggctcaagtctgatgtagaaaagggcctacctccaaagaaggaaacaattcttaaagttggaatgtctcagatgcaaaagcagtactatcgtgctctgcttcagaaagatttgggagggtattaaatccggtggtgaacgcaagcgattgcttaacattgccatgc

SEQ ID NO: 824 - DNA, 268 bp, Zea mays
gcaagatgcagcagctagctcgcaggcattctcagaagatcattgatgagaatcaaaagctgcgttcctgacttgaagcaaaaatgaatgatcctgatgtgagatccaagcaactcgatgagattgcaagcaaaagcggttatgacagaaagagccttgagcaggagaagccaaagaatgctatcaaatcgagtcatcctaaattggcaacattaaagcagcagaaagctgatgagaatgtgctgaagcctgtggggagacaaaaagg

SEQ ID NO: 825 - DNA, 119 bp, Zea mays
cagaaggagccttgagcaggagaagcaaaagaatgctatcaaatcgagtcatcttaaattggcaacattagagcagcagaaagctgatgagaatgtgctgaagcttgtggaagaacaaa

SEQ ID NO: 826 - DNA, 268 bp, Zea mays
tcggtattcggctcgaggctgaagcttgtggaagaacaaaaagtatgtaccttggctcctgtgatatgatgctttaggtttcaaacaatgtgtcctatggtagtcttactgtatggaaactacagagggagaaacatgctgcgttaaagaagattctgatgttggaacaacaattggatgcaaaacaaaagcttgaattagaaatacagcagttgaagggcaaactaaaagtgatggagcatatgccaggtgatgaagattcagcgtc

SEQ ID NO: 827 - DNA, 435 bp, Zea mays
ggagaagcaaaagaatgctatcaaatcgagtcatcttaaattggcaacattagagcagcagagagctgatgagaatgtgctgaagcttgtggaagaacaaaaagtatgtaccttggctcctgtgatatgatgctttaggtttcaaacaatgtgtcctatggtagtcttactgtatggaaactacagagggagaaacatgctgcgttaaagaagattctgatgttggaacaacaattggatgcaaaacaaaagcttgaattagaaatacagcagttgaagggcaaactaaaagtgatggagcatatgccaggtgatgaagattcagcgtcaaagaataaaattaatgagctgagtgaggcattgcaagaaaagatagatgaactggatggaatggagtcacttaaccaaactctggttatcaaagaaagcaaaagc

SEQ ID NO: 828 - DNA, 274 bp, Zea mays
gcctccctcgccacgcctcacagggccggttgcgtaggagaaaggagaaaggaaggaggggaggcggtcgtcgggcgagatgagcgactccttctgccccgactgcaagaagcatacggaggtggcgttcgaccactcggcgggggacatggtgtgcaccgagtgcggcctcgtcctcgaggcgcactccgtcgacgagacctccgagtggcgcaccttcgcgaacgagtccaacgacaacgaccccgtccgtgtcggtggccccaccaacccg

SEQ ID NO: 829 - DNA, 299 bp, Zea mays
atcctctcctgtgggcgctccctctccccggcccccaaatcaccgcgcctccctcgccacgcctcacagggccggttgcgtacgagaaaggagaaaggaaggaggggaggcggtcgtcgggcgagatgagcgactccttctgccccgactgcaagaagcatacggaggtggcgttcgaccactcggcgggggacatggtgtgcaccgagtgcagcctcgtcctcgaggcgcactccgtcgacgagacctccgagtggcgcaccttcgcgaacgagtccaacgacaacgaccccgtccgt

SEQ ID NO: 830 - DNA, 164 bp, Zea mays
gttgcgtaggagaaaggagaaaggaaggaggggaggcggtcgtcgggcgagatgagcgactccttctgccccgactgcaagaagcatacggaggtggcgttcgaccactcggcgggggacatggtgtgcaccgagtgcagcctcgtcctcgaggcgcactccgt

SEQ ID NO: 831 - DNA, 204 bp, Zea mays
ccatcctctcctgtgggcgctccctctccccggcccccaaatcaccgcgcctccctcgccacgcctcacagggccggttgcgtaggagaaaggagaaaggaaggaggggaggcggtcgtcgggcgagatgagcgactccttctgccccgactgcaagaagcatacggaggtggcgttcgaccactcggcgggggacatggtgtg

SEQ ID NO: 832 - DNA, 220 bp, Zea mays
ggagaaaggagaaaggaaggaggggacgcggtcgtcgggcgagatgagcgactccttctgccccgactgcaagaagcatacggaggtggcgttcgaccactcggcgggggacatggtgtgcaccgagtgcggcctcgtcctcgaggcgcactctgtcgacgagacctccgagtggcgcaccttcgcgaacgagtccaacgacaacgacgccgtccgtgtt

SEQ ID NO: 833 - DNA, 297 bp, Zea mays
cctctctcctgtgggcgctccctctcccccgcccccaaatcatcgcgcctccctcgccacgcctcacagggccggttgcgtaggagaaaggagaaaggaaggaggggaggcggtcgtcgggcgagatgagcgactccttctgccccgactgcaagaagcatacggaggtggcgttcgaccactcggcgggggacatggtgtgcaccgagtgcggcctcgtcctcgaggcgcactccgtcgacgagacctccgagtggcgcaccttcgcgaacgagtccaacgacaacgaccccgtcc

SEQ ID NO: 834 - DNA, 331 bp, Zea mays
  unsure (1)..(331): unsure at all n locations
tgcgacgagaaggagcaggcgngggggaggcggtcgtcgggcgagatgagcgactccgtctgccccgactgcaagaagcatacggaggtggcgttcgaccactcggcgggggacatggtgtgcaccgagtgcggcctcgtcctcgaggcgcactccgtcgacgagacctccgagtggcgcaccgtcgcgaacgagtccaacgacaacgaccccgtccgtgtcggcggccccacaaacccgctcctcactgatggcggcctctccaccgtcatcgccaagcccaacggcgcgccaggcgacttcctatcgtcctcactcggcaagttgcaga

SEQ ID NO: 835 - DNA, 314 bp, Zea mays
  unsure (1)..(314): unsure at all n locations
cacgcctcacagggccggttgcgtaggagaaaggagaaaggaaggaggggaggcggtcgtcgggcgagatgagcgactccttctgccccgactgcaagaagcatacggaggtggcgttcgaacactcggcgggggacatggtgtgcaccgagtgcggcctcgtcctcgaggcgcactcngtcgacgagacctccgagtggcgcaccttcgcgaacgagtccaacgacaacgaccccgtccgtgtcggcggccccacaaacccgctcctcactgatggcggctctccaccgtcatcgccaagcccaacggcgcgc

SEQ ID NO: 836 - DNA, 276 bp, Zea mays
ctcgagccgattcggctcgagtcgcgcctccctcgccacgcctagcagggccggttgcgtaggagaaaggagaaaggaagcaggggaggcggtcgtcgggcgagatgagcgactccttctgccccgactgcaagaagcatacggaggtggcgtcgaccactcggcgggggacatggtgtgcaccgagtgcggcctcgtcctcgaggcgcactccgtcgacgagacctccgagtggcgcaccttcgcgaacgagtccaacgacaacgaccccgtccg

SEQ ID NO: 837 - DNA, 406 bp, Zea mays
cagacgcgtgggctgaattcttcaggctgcttagatgattcagggtacgtcccgccatgttcggataattctgaccaagtgaaccgaccaccagcaacctttgtgaaggtttacaaatctggaacctacggaaggtcgcttgatatcaccaggtttagtagctatcacgagctccgtagggaactagggcgcctatttggccttgagggccagttggaagaccctctgagatcaggctggcagcttgtattcgtcgaccgcgaggaggacgtccttctcgtgggcgacgacccttggcaggaattcgcgagcacggtgtcctgcataaagatactctcgccgcaggaggtgcagcagatgggcaagcagggcctggagctcctgagctcggcccccgcggcgcgga

SEQ ID NO: 838 - DNA, 301 bp, Zea mays
ttctgtccttaattcccgtgtttctcgtccgtctccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctctgggagatgaaaatgctacactgtggcgcgatctcggggaacatagaccgaaccaaggctgct

SEQ ID NO: 839 - DNA, 292 bp, Zea mays
ccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctctgggagatgaaaatgctacactgtggcgcgatctcggggaacatagaccgaaccaaggctgctgccgcgtcctcggaggcacaccggc

SEQ ID NO: 840 - DNA, 285 bp, Zea mays
ccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaaggtccgcgaggatttcatcacctactgagtcggtgacgccgtcctaaacgagctctcaggctctctgggagatgaaaatgctacactgtggcgcgatctcggggaacatagaccgaaccaaggctgctgccgcgtccgtcggagg

SEQ ID NO: 841 - DNA, 379 bp, Zea mays
cccacgcgtacgccctcctccgccgaatcctctcctccggccgccgaaaccctagccggcgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctagtgggagatgaaaatgctacactgctgctcgatctctgagaacatagaccgaaccaaggttgctgacgcgtacgtcggaggcaccaccggcacgacaacggccgtgcacgacctgaacgtgccgtacgaggccacatcttaggagtacgccaacccgaccgctgacatgctgtttccggcgaca

SEQ ID NO: 842 - DNA, 288 bp, Zea mays
cggtccagtccgagggaagaaggcaagaagctcccggcgcgcgcgcgcaagcgagaggaaatggcgaccagcaacggctcaggggtcgcgcagggggaggaggggaagacgccaccgcctgcggggtcgatcggcgggtacgagtccctgcacaggctcctggaggccaacctttcccccgatctattccaggaagcaagtcgattgctgctgggactgaattgtgcacgacctcttgaggctatctcactgcctgacgccacaagccctcttgcggaaacacacagt

SEQ ID NO: 843 - DNA, 244 bp, Zea mays
gtgttgatgcttattctgccgctgctctgagggctagtccatatgcagttcctggcttgcgtgctagtgggtttatgggcagccaggttattctgccgcttgcacataccttagagcatgaagagttcttggaggttattaggcttgagggacacagcctctgccatgacgaagttgttctgtcacgagatatgtatcttctgcagttgtgcagcggtgtggatgaaaatgcagctggtgcatg

SEQ ID NO: 844 - DNA, 213 bp, Zea mays
cgacgctgggcggatcgcgtggggaacaacaacaagcagaggagcaacgaggagtggactgtcgtactctcccctgagcagttccgcatcctccgcctcaagggcaccgagttacccgggacaggagagtacaacaaattctacggcgacggggtttataactgcgctggctgcgggactcccctgtacaagtccgccacaaaatttgattct

SEQ ID NO: 845 - DNA, 210 bp, Zea mays
  unsure (1)..(210): unsure at all n locations
ggacgctggcggnacgcgtggggcgaacaacaacaagcagaggagcgaggaagcgtggcgcgtcgtactctcccctgagcagttccgcatcctccgcctcaagggcaccgagttacccgggacaggagagtacaacaaattctacggcgacggggtttataactgcgctggctgcgggactcccctgtacaagtccgccacaaaatttga

SEQ ID NO: 846 - DNA, 262 bp, Zea mays
ggcgtttgcggggccggtgctttctcttccttccggccgcggcaatggcgtcggggaacaagaacaagcagaggagcgaggaggagtggcgcgtcgtactctcccctgagcagttccgcatcctccgcctcaagggcaccgagttaccagggacaggagagtacaacaaattctacggtgacggggtttataactgcgctggctgcgggactcccttgaacaagtccgccacaaaatttgattctggctgcggctggctaca

SEQ ID NO: 847 - DNA, 284 bp, Zea mays
attcctcccacacgtccccatcaccattgctgcgacgagagtgcgcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgtta

SEQ ID NO: 848 - DNA, 274 bp, Zea mays
agactcgagaggcacctgatctttccttcccgtcttcctcccacacgtggccatcaccattgctgcgacgagagtgagcgggagagggtaggtggcgaggcggcggagatggggcgggggccggtgcagctgcgccggatcgagaacaagatcaaccgccagtgaccttctccaagcgccggaacggctgctgaagaaggcccacgagatctccgtgctctgcgacgcaaggtcgcgctcatcgtcttctccactaaggggaagctctacgagt

SEQ ID NO: 849 - DNA, 293 bp, Zea mays
gaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaag

SEQ ID NO: 850 - DNA, 294 bp, Zea mays
atctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggagaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgag

SEQ ID NO: 851 - DNA, 294 bp, Zea mays
actcgagtcgagactcgagaggcacctgatctttccttcccgtcatcctcccacacgtccacatcaccattgctgcgacgagagtgagcgggagagggtaggtggcgaggcggcggagatggggcgggggccggtgcagctgcgccggatcgagaacaagatcaaccgccaggtgaccttctgcaagcgccggaccgggctgctgaagaaggcccacgagatctccgtgctctgcgacgcagaggtcgcgctcatcgtcttctccactaaggggaagctctacgagtactctag

SEQ ID NO: 852 - DNA, 272 bp, Zea mays
cgagaggcacctgatctttccttcccgtcttcctcccagacgtccccatgaccattgctgcgacgagagtgagcgggagagggtaggtggcgaggcggcggagatggggcgggggccggtgcagctgcgccggatcgagacaagatcaaccgccaggtgaccttctccaagcgccggaacgggctgctgaagaaggcccacgagatctccgtgctctgcgacgcagaggtcgcgctcatcgtcttctccactaaggggaagctctacgagta

SEQ ID NO: 853 - DNA, 364 bp, Zea mays
ctcgagtcgagactcgagaggcacctgatctttccttcccgtcttcctcccacacgtccccgtcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaagcattcttgagcgttaccagcgttacctcattgaaagaagggcagtacttaacc

SEQ ID NO: 854 - DNA, 329 bp, Zea mays
ctcgagaggcacctgatctttccttcccgtgttcctcccacacgtccccatcaccattgctgcgacgagagtgagcgggagagggtaggtggcgaggcggcggacatggggcggctgccggtgcagctgcgccggatcgagaacaagatcaaccggctggtgaccttctccaagcgcctgaacgggctgctgaagaatgcccacgagatcttcgtgctctgcgacgcagatgtcgggctcatcgtcttctgcactaacgtgaagctctacgagtactctaggcattccagcatggatggcattctcgagcgttaccaacgttactcatt

SEQ ID NO: 855 - DNA, 237 bp, Zea mays
ggaagtggaagtcagggagctgaaggaactagccaacttcttgggaaaaggaaaatacaagatctggttgcacaggtagatcccttaggcaaggttgacacagaagtggaggatttacttctagaaatcgctgatgacttcattggctcggtgactgcatttgcgtgtaccttggcaaagcacaggaaatcatcagttgtcgaagccaaggatgtgttgctgcacttagagaaaaat

SEQ ID NO: 856 - DNA, 183 bp, Zea mays
ggaagtggaagtcagggagctgaaggaactagccaacttcttgggaaaaggaaaatacaagatctggttgcacaggtagatcccttaggcaaggttgacccagaagtggaggatttacttctagaaatcgctgatgacttcattggctcggtgactgcatttgcgtgtaccttggcaaagcac

SEQ ID NO: 857 - DNA, 184 bp, Zea mays
ggaagtggaagtcagggagctgaaggaactagccaacttcttgggaaaaggaaaatacaagatctggttgcacaggtagatcccttaggcaaggttgacccagaagtggaggatttacttctagaaatcgctgatgacttcattggctcggtgactgcatttgcgtgtaccttggcaaagcaca

SEQ ID NO: 858 - DNA, 272 bp, Zea mays
ggaaatcttgaggctcatttcaatggtttcagatattctacttcaaggtctgatgagcgtgtggacatcatgtttggaaatataaagcatgcctttttccagcctgcagagaaagaaatgattactctccttcacttccatttgcacaaccatatcatggttggaaacaagaagacaaaggatgttcagttctatgttgaagttatggatgttgtacagacgcttgggggcagtagaagatcggcacttgatcctgatgagattgaagaaga

SEQ ID NO: 859 - DNA, 281 bp, Zea mays
gtggacatcatgtttggaaataaaagcatgcctttttccagcctgcagagaaagaaatgattactctccttcacttccatttgcacaaccatatcatggttggaaacaagaagacaaaggatgttcagttctatgttgaagttatggatgttgtacatccgcttgggggcagtagaagatcggcacttgatcctgatgagattgaagaagagcagcgtgagagggataggaagaacagaataaacatggatttaccagaactttgtgaacaagttaacgac

SEQ ID NO: 860 - DNA, 247 bp, Zea mays
  unsure (1)..(247): unsure at all n locations
cggaacgctggngggcgtggcggggcacaagaggagcggctccatggacggggacacctcgccgttcganggcgaatcggcgccgccgtccgtgctgccggactacgccaagaaggccgtgcccgacgacaagctcgccgagctcgcgctcctcgatcccaagcgcgccaagaggatcctggcgaaccggcagtccgcggcgaggtccaaggagaggaagatcaagtacaccagtgagctggagagg

SEQ ID NO: 861 - DNA, 274 bp, Zea mays
gcggagctctccctcgacgccgccttcttcgacggcctctcgctacagggaggcgggggcgtggcggggcacaagaggagcggctctatggacggggccacctcgccgttcgagggcgagtccgcgccgacgtccgtgctgccggactacgccaagaaggccgtgcccgacgacaggctcgccgagctcgcgctcctcgaccccaagcgcgccaagaggatcctggcgaaccggcagtctgcggcgaggtccaaggagaggaagatcaagtaca

SEQ ID NO: 862 - DNA, 142 bp, Zea mays
cgcgcggtttggtgctgaaatggttttcagttctaaggacagcacaataactgatgaggacattgaccgtattatagctaaaggagaggagaccacagctgaacttgatgccaaaatgaaaaagttcacagaggacgccatt

SEQ ID NO: 863 - DNA, 264 bp, Zea mays
aggtgattgagagagcatataagaagctagcattggatgctttagttattcagcaaggacgattggcagagcagaaaactgtcaataaggatgaccttctgcaaatggtgcggtttggtgctgaaatggttttcagttctaaggacagcacaataactgatgaggacattgaccgtattatagctaaaggagaggagacaacagctgaacttgatgcaaaaatgaaaaagttcacagaggacgccattaaatttaagatggatg

SEQ ID NO: 864 - DNA, 226 bp, Zea mays
ggcattgctcagaaagagatccaaagtgttgcagaggagtctgcctaggccaccggctgtttcagtagagattatccggcaatctcttattagaagtggagaaagcagaagcagaagcacctttatgcctcctacatcacttgaacaagctgatgaactaataaatgaggaactccttaggcttcttgagcatgataatgcaaaatatcctcttgatgaaaaactc

SEQ ID NO: 865 - DNA, 286 bp, Zea mays
gaaagggctgaggaacaagctaggcatgaggcattgctcagaaagagatccaaagtgttgcagaggagtctgcctaggccaccggctgtttcagtagagattatccggcaatctcttattagaagtggagaaagcagaagcagaagcacctttatgcctcctacatcacttgaacaagctgatgaactaataaatgaggaactccttaggcttcttgagcatgataatgcaaaatatcctcttgatgaaaaaactcaaaaagagaaaaagaaaggaagcaagcgtc

SEQ ID NO: 866 - DNA, 305 bp, Zea mays
gggctgaggaacaagctaggcatgaggcattgctcagaaagagatccaaagtgttgcagaggagtctgcctaggtcaccggctgtttcagtagagattatccggcaatctcttattagaagtggagaaagcagaagcagaagcacctttatgcctcctaatcacttgaacaagctgatgaactaataaatgaggaactccttaggcttcttgagcatgataatgcaaaatatcctcttgatgaaaaaactcaaaaagagaaaaagaaaggaagcaagcgtcagcaaaatggaggacctcttgtcc

SEQ ID NO: 867 - DNA, 229 bp, Zea mays
gcacgagttcctgctgagctcaaaccccttccgcctccccatccaccattccatccgccgccgccgccgccgcctgtgcaagatgaatgtggagaagctcaagaagatggctggcgctgtacgcaccggagggaagggcagcatgcgcaggaagaagaaggcagttcacaagaccacgaccaccgatgacaagcggcttcagagcaccttgaaaaggatcggggggaac

SEQ ID NO: 868 - DNA, 354 bp, Zea mays
  unsure (1)..(354): unsure at all n locations
cccccnctagacccgcacgcaagcatactcaggcactcggctcgagcctttctgctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaag

SEQ ID NO: 869 - DNA, 311 bp, Zea mays
cgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaagcatccattcctgcaaatacatgggtagtcagtggagtaccccagacaaaaagtctacaagacc

SEQ ID NO: 870 - DNA, 278 bp, Zea mays
gagaagctcaagaagatggcgggtgctgtgcgcactggaggaaagggcagcatgcgcagaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaagcatccattcctgcaaatacatgggtagtcagtggagtaccccagacaaaaagtctacaagacctt

SEQ ID NO: 871 - DNA, 320 bp, Zea mays
ggccgagcgacccgcccacgcgtccggctcaagaagatggctggcgctgtacgcaccggagggaagggcagcatgcgcaggaagaagaaggcagttcacaagaccacgaccacagatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcaattatcaacca

SEQ ID NO: 872 - DNA, 244 bp, Zea mays
cactattcctttctgctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactat

SEQ ID NO: 873 - DNA, 230 bp, Zea mays
cactattcctttctgctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaatt

SEQ ID NO: 874 - DNA, 299 bp, Zea mays
caagagggaagggcagcatgcgcaggaagaagaaggcagttcacaagaccacgaccaccgatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcaattatcaaccaactgggccctgataacctggacaaccttaagaag

SEQ ID NO: 875 - DNA, 263 bp, Zea mays
atctgcttcctgctgagctcaaaccccttccgcctccccatcaaccattccatccgccgccgccgccgcctgcgcaagatgaatgtggagaagctcaagaagatggctggcgctgtacgcaccggagggaagggcagcatgcgcaggaagaagaaggcagttcacaagaccacgaccacagatgacaagcggcttcagagcaccttgaaaaggatcggggggaacaccattcctggtatcgaggaggtcaacatcttcaagga

SEQ ID NO: 876 - DNA, 279 bp, Zea mays
aattcctttctgctgagctcaggaaatcccctctggtctccccgtcccccattccacccgccgccgccgacgcgccgcgcctgtacaagatgaatgtggagaagctcaagaagatggcgggtgctgtgcgcactggaggaaagggcagcatgcgcaggaagaagaaggcagtccacaagaccgcaaccaccgatgacaagcggcttcaaagcacgttgaaaagaattggagtgaacactattcctggtattgaggaggtcaacatcttcaaggatgata

SEQ ID NO: 877 - DNA, 232 bp, Zea mays
gaagaaggcagttcacaagaccacgaccaccgatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcatttatc

SEQ ID NO: 878 - DNA, 171 bp, Zea mays
ctttctgctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagcccac

SEQ ID NO: 879 - DNA, 261 bp, Zea mays
gctgagctcaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagagcacactattcctggtattgaggaggtcaacatcttcaag

SEQ ID NO: 880 - DNA, 171 bp, Zea mays
caagattggagtgaacactattcctggtattgaggaggccaacatctgtcaaggatgctattgtgatccaattccagaacgctaaagtgcaagcatccattcctgcaaatacatgggtaatcagtggagtaccccagacacaaagtctacgagaccttctgccaacaatta

SEQ ID NO: 881 - DNA, 188 bp, Zea mays
gcaaatacatgggtagtcagtggagtaccccagacaaaaagtctacaagaccttctgccaacaattatcaaccaactgggccctgataacctggagaacctcaagaggcttgctgagcatttccagaagcaggtacctggtgccgaagccagcgccagtgcagctgcccaggatgaggacgatgtccc

SEQ ID NO: 882 - DNA, 301 bp, Zea mays
  unsure (1)..(301): unsure at all n locations
ccccgtcncccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcagggatgatattgttatccaattccagaaccctaaagtgcgagcatccacctgcaaatacatgggtagtca

SEQ ID NO: 883 - DNA, 318 bp, Zea mays
acccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaagcatccattcctgcaaatacatgggtagtcagtggagtaccccaga

SEQ ID NO: 884 - DNA, 158 bp, Zea mays
gcaaatacatgggtagtcagtggagtaccccagacaaaaagtctacaagaccttctgccaacaattatcaaccaactgggccctgataacctggagaacctcaagaggcttgctgagcatttccagaagcaggtacctggtgccgaagccagcgccag

SEQ ID NO: 885 - DNA, 402 bp, Zea mays
agcttcctgctgagctcaaaccccttccgcctccccatcaaccattccatccgccgccgccgccgcctgcgcatgatgaatgtggataagctcaacaagatggctggcgctgtatgcaccggacggaacggcagcatgcgcatgaagaagaaggcagttcacaagaccacgatcacagatgataagcggcttcagatcaccttgaaaaggatcagggggaacaccattcctggtaacgatgaggtcaacatcttcataggacgatgttgttatccagtttcagaacccgaaagtgcatgcatccattcctgcaaatacataggtggttagtggagtaccccagacaaaaagtctgcaagaccttctgccatcagttatcaaccaactgggccttgataacct

SEQ ID NO: 886 - DNA, 428 bp, Zea mays
cccacgcgtccggaagatggctggcgctgtacgcaccggagggaagggcagcatgcgcaggaagaagaaggcagttgacaagaccacgaccacagatgacaagcggcttcagagcaccttgaaaaggatcggggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcaattatcaaccaactgggccctgataacctggacaaccttaagaagctggctgagattttccagaggcaggtacctggtgctgaagcagctgcacaggatgatgacgacgtccctgagcttgtccaaagagagacatttg

SEQ ID NO: 887 - DNA, 389 bp, Zea mays
atcaagaatatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaagcatccattcctgcaaatacatgggtagtcagtggagtaccccagacaaaaagtctacaagaccttctgccaacaattatcaaccaactgggccctgataacctggagaacctcaagaggcttgctgagcatttccagaagcaggtacctggtgccgaagccagcgccagtgcagctgccca

SEQ ID NO: 888 - DNA, 206 bp, Zea mays
cttttccccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacaga

SEQ ID NO: 889 - DNA, 273 bp, Zea mays
ccgctcgagagctagcctcacgagccctatctatccttttctcggcacctcgcgggtctcccgtccgccacgtcccgcattcgtaccctctcctcactctcgccgccgccgcttcccctgcgcaccgagccaagatgaatgtcgagaagctcaagaagatggcacgtgctgtgcgcactgggaggaagggtagcatgcgcaggaagatgaaggcagtccacaagactacgaccacagatgataagaggcttcagagcaccctgagaagaatag

SEQ ID NO: 890 - DNA, 273 bp, Zea mays
cgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctg

SEQ ID NO: 891 - DNA, 273 bp, Zea mays
cgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataagaggcttcagagcaccctgaaaagaataggagtgaacaccattcctggtattgaagaggtcaacatctttaaggatgatgttgttattcagtttgtgaa

SEQ ID NO: 892 - DNA, 246 bp, Zea mays
cccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagc

SEQ ID NO: 893 - DNA, 304 bp, Zea mays
cccacgcgtccgcccacgcgtccgcccacgcgtccgcccgggtctccagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatg

SEQ ID NO: 894 - DNA, 289 bp, Zea mays
cttttccccactcccgggtctccagcattcctatcctccccccgcccgcccgtcccgccgccgcggcttcccttcctctcccgagccaagatgaatgttgaaaagctcaagaagatggcaggtgctgtgcgcaccggggggaagggtagcgtgcgcaggaagaagaaggcagtccacaacactacaaccacacatgacaaacggcttcaaagcaccttgaaaagaataggagtgaacagcattcctggtattgaagaggtcaacatctttaaggatgatgttgttattc

SEQ ID NO: 895 - DNA, 320 bp, Zea mays
cggacggtggcgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggagg

SEQ ID NO: 896 - DNA, 304 bp, Zea mays
ctcctcactctcgccgccgccgcttcccctgcgccccgagccaagatgaatgttgaaaagctcaagaagatggcaggtgctgtgcgcactgtggggaagggtagcatgcgcaggaagaagaaggcagtccacaagactacgaccacagatgataagaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaa

SEQ ID NO: 897 - DNA, 308 bp, Zea mays
gttgaaaagctcaagaagatggcaggtgctgtgcgcactggggggaagggtagcatgcgcaggaagaagaaggcagtccacaagactacgaccacagatgataagaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcgg

SEQ ID NO: 898 - DNA, 299 bp, Zea mays
cgagccaagatgaatgttgaaaagctcaagaagatggcaggtgctgtgcgcactggggggaagggtagcatgcgcaggaagaagaaggcagtccacaagactacgaccacagatgataagaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgct

SEQ ID NO: 899 - DNA, 308 bp, Zea mays
cccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataagaggcttcagagcaccctgaaaagaataggagtgaacaccattcctggtattgaagaggtcaacatctttaaggatgatgttgttattcagtttgtgaatcctaaagtgcaagcttcaattgg

SEQ ID NO: 900 - DNA, 243 bp, Zea mays
cttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataagaggcttcagagcaccctgaaaagaataggagtg

SEQ ID NO: 901 - DNA, 324 bp, Zea mays
cccacgcgtccgtttccccactcccgggtctccagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagc

SEQ ID NO: 902 - DNA, 311 bp, Zea mays
atccttttccccactcccgggtctccagcattcctatcctctacccgcccgcacgtgccgccgccgcgcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtg

SEQ ID NO: 903 - DNA, 301 bp, Zea mays
ggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagacatattccagaagcaggcctctggtgcttctggtgcagaggctggtgccagcgctggggctgttcaggacgatgatgatgacgttcctg

SEQ ID NO: 904 - DNA, 260 bp, Zea mays
agtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcggacaattccagaagcaggcccctggtgcttcaggtgcagaggctggcgccagcgctggtgctgctcaggacgatgacgatgacgttcctgagctcgtcgctggagagacat

SEQ ID NO: 905 - DNA, 264 bp, Zea mays
cagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgtta

SEQ ID NO: 906 - DNA, 237 bp, Zea mays
agcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattc

SEQ ID NO: 907 - DNA, 242 bp, Zea mays
cccacgcgtccgcccacgcgtccgcccacgcgtccggaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcgg

SEQ ID NO: 908 - DNA, 227 bp, Zea mays
agcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggta

SEQ ID NO: 909 - DNA, 173 bp, Zea mays
atcacgggtctccagcattcctatcctctcgccgcccgcacgtaccgccgccgccgccgccgccgcggcttcccttcctctcccgagccaagatgaatgttgaaaagctcaagaagatggcaggtgctgtgcgcaccggggggaagggtagcgtgcgcaggaagaagaaggca

SEQ ID NO: 910 - DNA, 288 bp, Zea mays
tttcaccactcccgggtctccagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattca

SEQ ID NO: 911 - DNA, 216 bp, Zea mays
ccttttcaccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagagggcactccagaatactacaaccacagatgacaaggg

SEQ ID NO: 912 - DNA, 238 bp, Zea mays
cccactcccgggtctccagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattc

SEQ ID NO: 913 - DNA, 330 bp, Zea mays
  unsure (1)..(330): unsure at all n locations
cttttcaccactcgcgggtctccagcattcctatcctctccccgcacgcccgtgccgccgccgcggttcccttcctctaccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtanatcctanagtgcaagcgtcaattggtgctaata

SEQ ID NO: 914 - DNA, 307 bp, Zea mays
gacaaccgtccgcgacgcggcagccagccagtgagctagcctcccgagccctatctatccttttatcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaacggtagcatgcgcaggaagaagaaggcagtccacaagactacgaccacagatgataagaggcttcagagcaccctgaaaagaataggagtgaacac

SEQ ID NO: 915 - DNA, 269 bp, Zea mays
cccgggtctccagcattcctatcctctccccgcccgcccgtgccgccgccgcggcttcacttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgt

SEQ ID NO: 916 - DNA, 266 bp, Zea mays
cccgggtctccagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgg

SEQ ID NO: 917 - DNA, 261 bp, Zea mays
atctttaaggatgatgttgttattcagtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcggacaattccagaagcaggcccctggtgcttcaggtgcagaggctggcgccagcgctggtgctgctcaggacgatgacgatgacgttc

SEQ ID NO: 918 - DNA, 267 bp, Zea mays
cccacgcgtccgcccacgcgtccggtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcggacaattccagaagcagcccctggtgcttcaggtgc

SEQ ID NO: 919 - DNA, 269 bp, Zea mays
cgagccctatccttttccccactcccgggtctccagcattcctatcctctccccgcccgcccgtaccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagag

SEQ ID NO: 920 - DNA, 274 bp, Zea mays
cagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgt

SEQ ID NO: 921 - DNA, 287 bp, Zea mays
gcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaaga

SEQ ID NO: 922 - DNA, 264 bp, Zea mays
atccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataagaggcttcagagcaccctgaaaagaataggagtgaacaccattcctggtatt

SEQ ID NO: 923 - DNA, 301 bp, Zea mays
ctcccgagccaagatgaatgttgaaaagctcaagaagatggcaggtgctgtgcgcaccggggcgaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctg

SEQ ID NO: 924 - DNA, 149 bp, Zea mays
ccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaag

SEQ ID NO: 925 - DNA, 273 bp, Zea mays
ggatgatgttgttattcagtttgtgaatcctaaagtgcaagcttcaattggtgctaatacatgggtggtcagtggaactccacagacaaagaagctgcaagatctgcttccgtccattatcaaccagctcggccctgacacctagacaacctgcggaggcttgcggagcaattccagaagcaggcccctggtgcttcaggtgcagaggctggcgccacgctggtgctgctcaggacgatgacgatgacgttcctgagctcgtccctggagaga

SEQ ID NO: 926 - DNA, 269 bp, Zea mays
tgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcggagcaattccagaagcaggcccctggtgcttcaggtgcagaggctggc

SEQ ID NO: 927 - DNA, 254 bp, Zea mays
ccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggt

SEQ ID NO: 928 - DNA, 328 bp, Zea mays
  unsure (1)..(328): unsure at all n locations
cnccgcccgcccgtgccgccgccgcggctttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcattggtgctaatnatgggtggtcatggactccacagacaagagctgcaa

SEQ ID NO: 929 - DNA, 240 bp, Zea mays
cagcattcctatcctctccccgcccgcccgtgccgccgccgcggcttcccttcctactcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtc

SEQ ID NO: 930 - DNA, 291 bp, Zea mays
cccgggtctccagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcct

SEQ ID NO: 931 - DNA, 263 bp, Zea mays
ctctcgccgccgccgcttcccctgcgccccgagccaagatgaatgttgaaaagctcaagaagatggcggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagctt

SEQ ID NO: 932 - DNA, 242 bp, Zea mays
cttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagt

SEQ ID NO: 933 - DNA, 399 bp, Zea mays
gttcgcagtgggcagtggcagccagccagtgagctagcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaataca

SEQ ID NO: 934 - DNA, 402 bp, Zea mays
gttcgcagtgggcagtggcagccagccagtgagctagcctcccgagccctatctatccttttctcggcacctcgcgggtctcccgtccgccccgtcccgcattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaatacatgg

SEQ ID NO: 935 - DNA, 260 bp, Zea mays
agcatgcctatcctctccccgcccgcccgtgccgccgccgcggcttcccttcctctcccgagcggagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaaggatgatggt

SEQ ID NO: 936 - DNA, 365 bp, Zea mays
cttttccccactcccgggtctccagcattcctatcctctccccgcccgcccgtgccgccgccgcggcttccgttggtctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaa

SEQ ID NO: 937 - DNA, 425 bp, Zea mays
cggacgcgtggggttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgccagcgctggggctgttcaggacgatgatgatgacgttcctgagcttgtccctggagagacatttgaggaggccgcggaagagaaaaaggagtcctcatgattttgctacatgcctgctgttgttaaaccatgccattagaagggacctgttgagaactctgacctaccttatttgtgcctgtgggactggttatgtcatgatcg

SEQ ID NO: 938 - DNA, 276 bp, Zea mays
cccacgcgtccgtgaatgttgaaaagctcaagaagatggcaggtgctgtgcgcaccggggggaagggtagcgtgcgcaagaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtgggcagtggaactccac

SEQ ID NO: 939 - DNA, 465 bp, Zea mays
gccgccgccgcttcccctgcgccccgagccaagatgaatgttgaaaagctcgagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcggagcaattccagaagcaggcccctggtgcttcaggtgcagaggctggcgccagcgctggtgctgctcaggacgatgacgatgac

SEQ ID NO: 940 - DNA, 278 bp, Zea mays
gcgcaggaagaagaaggcagtccacaagactacgaccacagatgataaaaggcttcggagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggacctgacaacctagacaacctgcgga

SEQ ID NO: 941 - DNA, 413 bp, Zea mays
cccacgcgtccgcccacgcgtccgcggacgcgtgggcactcccgggtctccagcattcctatcctctccccgcccgcccgtgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggttgtcagtggaactcgacagacaaagaagctgcaagatctgcttccgt

SEQ ID NO: 942 - DNA, 237 bp, Zea mays
gaagaactggatcttcttcatacgattacagaagttcttctggaggaggaacagtcattcttgatgattgcaatttccatgagtcagtacatctggacagttttgatattgacagaactttgactttaataccgcccgatggagaatttcctgtaatgaactaccgtatgacccaagaatttaagccaccattccgtgtaaccgcactaattgaagaagctggaccagcgagggctg

SEQ ID NO: 943 - DNA, 327 bp, Zea mays
cacgcgtgcacgggcgggcaagcaccagaaaggagaggcggaggccgcgcggcaggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcatgtgaccttctcgaagcgccgcaacgggctgctcaagaaggccttcgagctctccgtgctctgcgatgctg

SEQ ID NO: 944 - DNA, 310 bp, Zea mays
cccacgcgtccgcggaggccgcgcggcgggcgccagctgcagccaagagcccactagtagtagtagtagctagttcaacaccgcctgattgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggc

SEQ ID NO: 945 - DNA, 404 bp, Zea mays
ggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagcccttagaaagaccaaacgaatgtttctgggtgaaaatttaaaaga

SEQ ID NO: 946 - DNA, 305 bp, Zea mays
  unsure (1)..(305): unsure at all n locations
ggctcgagagcatctccgctccggctgcgctcagccttgctttcctgacaccagctctagcgcgaggacgagaggtacggcggccgatctggcggcgcaggcggagggctcggccggggccggcaagtcggcgccgaacatggggaggggccgggtcgagctcaagcggatcgagaacaagatcaaccgccaggtcaccttcgacaagcgccgcaacggcctgctcaagaaggcgtacgagctctcggtgctctgcgacgccgangtcgcgctcatcatcttctccaaccgcggcaagctctacg

SEQ ID NO: 947 - DNA, 319 bp, Zea mays
  unsure (1)..(319): unsure at all n locations
ccctcatcctccgctccagacttccagcatctccgctccggctgcgctctgccttgctttcctgctacctgctctagcgcgacgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgangtcgcgctcatcatcttctccaaccgcggcaagctcta

SEQ ID NO: 948 - DNA, 299 bp, Zea mays
atctccgctccggctgcgctctgccttgctttcctgcgacctgctctagcgcgacgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagatagcgtacgagctctcggtgctctgcgacgctgaggtcgcgctcatacatctctccaaccgcggcaagctctacgagttct

SEQ ID NO: 949 - DNA, 395 bp, Zea mays
agcatctccgctccggctgcgctctgccttgctttcctgctacctgctctagcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgag

SEQ ID NO: 950 - DNA, 459 bp, Zea mays
cccacgcgtccgcggacgcgtgggccagcatctccgctccggctgcgctctgccttgcggtgctgctacctgctctagcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggggttccagctctcggtgctctgcgacgccgaagtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaa

SEQ ID NO: 951 - DNA, 420 bp, Zea mays
atctccgctccggctgcgctctgccttgctttcctgctacctgttctagcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacc

SEQ ID NO: 952 - DNA, 310 bp, Zea mays
agcaggaagaagcgacctcgcagatcacgagatgggcctacgtcagtggcagctgtcatccagcggtgggctgagcgcaacaagcatttggagtatgaggaatctgaggaggcaaagcgaccaagaaaagcacctgcaaagggttcaaagaagggctgtatgaagggaaaaggggggcctgacaatactcaatgtggataccgtggagtgaggcagcgtacttgggggaagtgggttgctgaaataagagagccaaatcgtgtcgacagactctggctgggtaccttcccaaccgcggaggatgcagcta

SEQ ID NO: 953 - DNA, 315 bp, Zea mays
ctcgtccgcttctctctcacccttccttcccctcctctcctgtggatgctccctccctctccggctctccgcctctcccccgccccccaagcccaaatcaccgcgcctcgccccacagcaccggttgcgtgggaggagggagggaggaaggaaggaggggaggcggctgtcgggcgagatgagcgactcctactgccccgactgcaagaagcatacggaggtggcgttcgaccattcggcgggggacacggtgtgcaccgagtgcggcctcgtcctcgaggcgcactccgtcgacgagacctccgagtggcgtac

SEQ ID NO: 954 - DNA, 275 bp, Zea mays
gcctcgtccgcttctctctcacccttccttcccctcctctcctgtggatgctccctccctctccggctctccgcctctcccccgccccccaagcccaaatcaccgcgcctcgccccacagcaccggttgcgtgggaggagggagggaggaaggaaggaggggaggcggctgtcgggcgagatgagcgactcctactgccccgactgcaagaagcatacggaggtggcgttcgaccattcggcgggggacacggtgtgcaccgagtgcggcctcgt

SEQ ID NO: 955 - DNA, 246 bp, Zea mays
caaagccaaaccctaattcacggccgccggagatgggacaaggttctcccggcgggatgggcaagcagcccggccttccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcg

SEQ ID NO: 956 - DNA, 300 bp, Zea mays
caaagccaaaccctaattcacggccgccggagatgggacaaggttctcccggcgggatgggcaagcagcccggcctcccgggcgaccgcaagcagggagacggcaagaaagagaagaaatatgaaccacccgctgcaccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaagaggagttcgttgccagccaggagc

SEQ ID NO: 957 - DNA, 217 bp, Zea mays
gtcggccggaagcagaagcggcagaagggctccgaggcggcggcgcggctccccgccgtggcgccgctctcaaagtgccgccttcgcctactcaagctcgaacgcgtcaaggactaccttctcatggaagaggagttcgttgccagccaggagcgcctgcgccccagcgaggataagacggaggaggaccgatccaaggtcgacgacctccgcggca

SEQ ID NO: 958 - DNA, 409 bp, Zea mays
agttgtaggaggatggtgcagtagtgtcttgaagacagttttctctcggttcggaattaccgggctcccccactttctccttgtcaccgagtcacaaagccaaaccttaattcacggccgccggagatgggacaaggttcgcccggcgggatgggcaagcagcccggcctcccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaaaaagagttcgttgccagccaagagcgcctgcgccccagcg

SEQ ID NO: 959 - DNA, 321 bp, Zea mays
ggagatatctcgaactaatgaagacatggaccttttctgcaacagctgctcttccccgaggcgggtttttggtcgcagttatttactaagtaagacaccttgcggtgaccattagagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtg

SEQ ID NO: 960 - DNA, 216 bp, Zea mays
ttttggtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacat

SEQ ID NO: 961 - DNA, 265 bp, Zea mays
ggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaag

SEQ ID NO: 962 - DNA, 310 bp, Zea mays
ccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagta

SEQ ID NO: 963 - DNA, 295 bp, Zea mays
agcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatg

SEQ ID NO: 964 - DNA, 170 bp, Zea mays
cgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgg

SEQ ID NO: 965 - DNA, 394 bp, Zea mays
cgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctac

SEQ ID NO: 966 - DNA, 154 bp, Zea mays
cgattttaaaatccaatacagcagtattgttcgcctctttcttttgccgaagtcaaacaaccctcatacatttgtttgtatcactcttgatccaacaaatccgtaaaggacaaacatggtatcctcacattgttatccagtttgagacagaggc

SEQ ID NO: 967 - DNA, 293 bp, Zea mays
ccatagccaacatggctgacaggctaggtcttgtggctactattaaggaccgagcaaatgaaatcttcaagaaaattgaagatctcaagtctattaggggaagaaatcaagatgccatattagccgcatgtctatatattgcttgtagacaagaagatcgccctagaactgtgaaagaaatatgttcggttgctaatggggccacgaagaaagaaattggcagagccaaagaatttatagtgaaacaactggaagttgagatggggcaatctatggagatgggaacattcatg

SEQ ID NO: 968 - DNA, 243 bp, Zea mays
  unsure (1)..(243): unsure at all n locations
ttatagccaacatggctgacaggctaggtcttgtggctactattaaggaccgagcaaatgatatcttcaagaaaattgaagatctcaagtctattaggggaagaaatcaagatgccatattagccgcatgtctatatattgcttgtagacaagaagatcgccctagaactgtgaaagaaatatgcacggttgctaatgggagcacgaagaaagaaattggcagagccanagaatttatagtga

SEQ ID NO: 969 - DNA, 279 bp, Zea mays
aataggaccgagcaaatgatatcttcaagaaaattgaagatctcaagtctattaggggaagaaatcaagatgccatattagccgcatgtctatatattgcttgtagacaagaagatcgagcttagaactgtgaaagaaatatgttcggttgctaatggggccacgaagaaagaaattggcagagccaaagaatttatagtgaaacaactggaagttgagatggggcaatctatggagatgggaaccttcatgctggagattttctgaggcgtgctgttc

SEQ ID NO: 970 - DNA, 325 bp, Zea mays
  unsure (1)..(325): unsure at all n locations
cgccaacatggctgaccggctaggtcttgtggctactattaaggaccgagcaaatgaaatctacaagaaagttgaagatctcaaatctatcaggggaagaaatcaagatgccatattagctgcatgcctatatattgcttgtagacaagaagatcggcctagaactgtgaaagaaatatgttcagttgctaatggggccacaaaganagaaattggcagagcaaaagaatttatagtgaaacaactggaagttgagatggggcaatctatggagatgggaacattcacgttcagatntctgagacgttctgctcactcttggatg

SEQ ID NO: 971 - DNA, 261 bp, Zea mays
  unsure (1)..(261): unsure at all n locations
tggtntngtagccacagtcagtcagccaatacgtacacacgcggggacatacaagcctctaaacagacgtcctataaaatcaagatgccatattagctgcatgcctatatattgcttgtagacaagaagatcggcctagaactgtgaaagaaatatgttcagttgctaatggggccacaaagaaagaaattggcagagcaaaagaatttatagtgaaacaactggaagttgagatggggcaatctatggagatgggaacca

SEQ ID NO: 972 - DNA, 288 bp, Zea mays
tccaaggtccaagggaggctgcaggcaggttgtctccctccttcccacctgcaccacccctacccctgccccccatctcatccatcaatgggaaggtcaccttgctgcgatgagaatggtctcaagaagggcccctggacccctgaagaagaccagaagctcatggagtacatccagaagaacggccatgggagctggagggcgctgcctaggcttgccgggctcaacaggtgtggcaagagctgcaggctgagatggaccaactacttgaggcaaacatcaaggagg

SEQ ID NO: 973 - DNA, 238 bp, Zea mays
acttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaag

SEQ ID NO: 974 - DNA, 232 bp, Zea mays
gcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaaga

SEQ ID NO: 975 - DNA, 232 bp, Zea mays
cggacggtgggttgacaagtacagcacacattctaaaaacctggggaaagcagaacagccttcacttgacacgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaa

SEQ ID NO: 976 - DNA, 261 bp, Zea mays
cacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcaaacgaaagggtacac

SEQ ID NO: 977 - DNA, 271 bp, Zea mays
aagttcggctcgagggataacagaacagccttcgctggacttgaacttagagcatagcatatatgcaaatttgaatgagcaacttgcggaagcaagccttcgactcaggcagatgagaggtgaagaacttgagggactgaatgttgatgaactccagcaattggagaagaacctggaatctggtctgcatagggtgcttcagacaaaggatcaacaattcttggaacagatcaatgacctcgaacgtaagagtacgcagctggcagaggag

SEQ ID NO: 978 - DNA, 400 bp, Zea mays
acccacgcatccggagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcagttggagaagaacctggaatctggtctgcatagggtgcttcaaacaaa

SEQ ID NO: 979 - DNA, 446 bp, Zea mays
gagtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggggaagaatctggaatctggtctgca

SEQ ID NO: 980 - DNA, 333 bp, Zea mays
  unsure (1)..(333): unsure at all n locations
aacctctgtctgcgtgctctcgccttggctgtcgattttactaatttggttgcttggatgtggaccgttggcttagatagtcaattagcatgaattacttcgcgtcctttacccagtttttatccattgcttcatggatctagtggcagagggacatatgcacaatgctcggtcatttttccatacatttcgggaagctcataaggtgatgcattcaagggatcttcagaagctggaaggcatcctctctccttcacacttggaggaaacggaactggctcgatcttttaggaaaaaataaatttanaattacattatgcgagtactcgtatg

SEQ ID NO: 981 - DNA, 262 bp, Zea mays
cccacgcgtccgcgaattacttcgcgtcctttatccagttttcatccatagcttcatggatctagtggcagaaggacatatgcaggaagctcggtcatttttccatacatttcgggaagatcatgaggtgatgcattcaagggatcttcagaagctggaaggcgtcctgtctccttcacacttggaggaaatggaattggcccggtcttttaggaaaaataaatttaaaattaaattatgtgagtattcgtatgaattgctt

SEQ ID NO: 982 - DNA, 152 bp, Zea mays
ctccggaaaagttggcccctgagctgaccagatcaccaagcaaagctgcaaggatgttttcaggaacacaagacaagtgtgcgacttgtggtaaaactgcgtatcctcttgagaaggtaacagtcgcagagaagtcctaccataagtcatgc

SEQ ID NO: 983 - DNA, 147 bp, Zea mays
gcggagggtgaacgcaagccattgcttaacattgccatgcagctgcgcaagtagctcaaccatccatatttgttccaaggagctgaacctggcccaccctacacaactggtgaacatctagttgagaatgccggaaaaatggttcta

SEQ ID NO: 984 - DNA, 314 bp, Zea mays
cggcaagagctgccggctgcgttgggtcaactacctccaccctggcctcaagcgtgggcgcatgtctcccaatgaagagcgcctcatccttgagctgcacgctcggtggggaaacaggtggtccaggatagcacggcgcttgccagggcgcactgacaatgagatcaagaactactggaggacacacatgaggaagaaagcacaggagaggaagaggaacatgtctccatcatcatcctcatcttcactgagttaccagtcaggctacccagatactccatcaatcattggagttaagggacaggagcttcatg

SEQ ID NO: 985 - DNA, 104 bp, Zea mays
aggtggtccaggatagcacgccgcttgccagggcgcactgacaatgagatcaagaactactggaggacacacatgagaaagaaggcacaagagaggaagaggaa

SEQ ID NO: 986 - DNA, 316 bp, Zea mays
ccttctgtatcttcatgcagggctcaaccggacaggcaagagctgccggctgcgctgggtcaactacctccaccctggcctcaagcgtgggcgcatgtctccccatgaagagcgactcatcctagagctgcacgctcggtggggaaacaggtggtccaggatagcacgccgcttgccagggcgcactgacaatgagatcaagaactactggaggacacacatgagatagaaggcacaagagaggaagaggaacatgtctccatcgtcgtcttcgtcttcgctgacttaccagtcaggctacccagatactccatca

SEQ ID NO: 987 - DNA, 353 bp, Zea mays
agaaccggacaggcaagagctgccggctgcgctgggtcaactacctccaccctggcctcaagcgtgggcgcatgtctccccatgaagagcgactcatcctagagctgcacgctcggtggggaaacaggtggtccaggatagcacgccgcttgccagggcgcactgacaatgagatcaagaactactggaggacacacatgagaaagaaggcacaggagaggaagaggaacatgtctccatcgtcgtcctcgtcttcgctgacttaccagtcaggctacccagatactccatcaaccattggagttgagggacaggagcttcatggtggcagtggctgcatcacaagcatcctg

SEQ ID NO: 988 - DNA, 94 bp, Zea mays
gcggcctctccaccgtcatcgccaagcccaacggcgcgcagggcgacttcctatcctcctccctcggcaggtggcagaaccgcggctccaaccc

SEQ ID NO: 989 - DNA, 254 bp, Zea mays
cgaggcgcactccgtcgacgagacctccgagtggcgtaccttcgccaacgagtccaacgacaacgaccccgtccgcgtcggcggcccctccaacccgctcctcaccgacggcggcctctccaccgtcatcgccaagcccaacggcgcccagggcgacttcctctcctcctccctcggcaggtggcagaaccgcggctccaaccccgaccgatccctcatcctcgccttccgcaccatagccaacatggctgaca

SEQ ID NO: 990 - DNA, 238 bp, Zea mays
cggacggtgggcgccgtgctgcgagaaggcgcacacgaacaagggcgcgtggaccaaggaggaggacgacagtctggtggcgtacatcaaggcgcacggcgaagggtgctggcgctcccttcccaaggccgccggacttgtgcgctgcggcaagagctgccgcctccggtggatcaactacctgcggcccgacctcaagcgcggcaacttcacggaggaggaggacgagctcatcatc

SEQ ID NO: 991 - DNA, 227 bp, Zea mays
cggacgcgtgggcgccgtgctgcgagaaggcgcacacgaacaagggcgcgtggaccaaggaggaggacgaccgactggtggcgtacatcaaggcgcacggcgaagggtgctggcgctcccttcccaaggccgccggacttgtgcgctgcggcaagagctgccgcctccggtggatcaactacctgcggcccgacctcaagcgcggcaacttcacggaggaggaggac

SEQ ID NO: 992 - DNA, 140 bp, Zea mays
cccacgcgtccgcccacgcgtccgggaggtcgccgtgctgcgagaaggcgcacacgaacaagggcgcgtggaccaaggaagaagacgaccgtctggtggcgtacatcaaggcgcacggcgaagggtgcttgcgctccctt

SEQ ID NO: 993 - DNA, 270 bp, Zea mays
caacgatggggatgtcgccgtgctgcgagaaggcgcacacgaacaagggcgcgtggaccaaggaggaggacgaccgtctggtggcgtgcatcaaggcgcacggcgaagggtgctggcgctcccttcccaacgccgccggacttgtgcgctgcggcaagatctgccgcctccagtggatcaactacctgcggcccgacctcaagcgcggcaacttcacggaggaagaggacgagctcatcatcaagctccacagcctactcggcaacaaat

SEQ ID NO: 994 - DNA, 280 bp, Zea mays
gcagtcgcagcaacgatggggaggtcgccgtgctgcgagaaggcgcacacgaacaagggcgcgtggaccaaggaggaggacgaccgtctggtggcgtacatcaaggcgcacggcgaagggtgctggcgctcccttaccaaggccgccggacttgtgcgctgcggcaagagctgccgcctccggtggatcaactacctaaggcccgacctcaagcgcggcaacttcacggaggaggaggacgagctcatcatcaagctccacagcctactcggcaacaaat

SEQ ID NO: 995 - DNA, 268 bp, Zea mays
cgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctg

SEQ ID NO: 996 - DNA, 267 bp, Zea mays
cctcgctcagtacctggattaactgtggaggttcacaaattggatccgctagttcagcgtgctttagctgctgctttacgatccaaagatcttcgaggtttgtatgacaggattccccctcatctcgagtcaaagcttatgccatttcagcgtgaaggcatcaggtttgttttacagcatggtggcagagccctgattgcagatgaaatgggtcttggaaagacactacaggcaattgctgttgcttcgtgccttcgtgatgcctgg

SEQ ID NO: 997 - DNA, 234 bp, Zea mays
caactgatgaaggccttgaacaggacactgtggatgctgttaatcctgaggagactactgccgtggtggaggatgagaagaaacctgaagatgcaccacagtctgaggttgagaaggacaaggagggcgcggagaatgaagaagaagaaaaggaacctgaggataaggagatgactttggaggaatatgaaaaggtactggaggaaaaacgaaaagctttactctcccttaagg

SEQ ID NO: 998 - DNA, 342 bp, Zea mays
  unsure (1)..(342): unsure at all n locations
aggacactgtggatgctgttaatcctgaggagactactgccgtggtggaggatgagaagaaacctgaagatgcaccacagtctgaggttgagaaggacaaggagggcgcggagaatgaagaagaagaaaaggaacctgaggataaggagatgactttggaggaatatgaaaaggtactggaggaaaaacgaaaagctttactctcccttaaggctgaggagagaaaagttgaaattgacaaggagctacaggccatgcaacaactgtcagttaaaaaggatggcgatgaagtgtttatcaagctgggctctgacaaggacttgnaaaagaaagaaagtgctg

SEQ ID NO: 999 - DNA, 303 bp, Zea mays
gacacagcctctgccatgacgaattgttctgtcacgagatatgtatcttctgcagttgtgcagcggtgtggatgaaaatgcagctggtgcatgtgcacagcttgtgtttgcacccatcgatgaatcttttgccgacgatgcgccactgctaccctcaggcttccgtgtcattccactggatgcaaagacggatccaccatcaggcacacgcacacttgaccttgcatctaccctcgaggttggatctggtgggacaacgcgtgcttcgagtgacgcctccagcacctgcaacacaagatcagt

SEQ ID NO: 1000 - DNA, 243 bp, Zea mays
actggatgcaaagacggatccaccatcaggcacacgcacacttgaccttgcatctaccctcgaggttggatctggtgggacaacgcgtgcttcgagtgacgcctccagcacctgcaacacaagatcagtgctgaccattgctttccagttctcatatgaaaatcacctacgagagagcgtcgcagccatggccaggcaatacgtcaggaccgtggtggcatcggtgcagagggtagccatggc

SEQ ID NO: 1001 - DNA, 303 bp, Zea mays
gcttgacctagcatctactctcgaggttggatctggtgggactactcgcacttcaagcgatgcctccagcacctgcaacacaagatcggtgctgaccatcgctttccagttctcatacgagaatcacctacgagaaagcgtcgcagcgatggccaggcaatatgtcaggactgtggtggcatcggtgcagagggtggccatggcaatagctccttcccgtcttggtggacagcttgagatgaagcaaactcctggttcccctgaggcgcacacgcttgcgaggtggatcggcaagagctacag

SEQ ID NO: 1002 - DNA, 296 bp, Zea mays
gcggtgtggatgaaaatgcagctggtgcatgtgcacagcttgtgtttgcacccatcgatgaatcttttgccgacgatgcgccactgctaccctcaggcttccgtgtcattccactggatgcaaagacggatccaccatcaggcacacgcacacttgacttgcatctaccctcgaggttggatctggtgggacaacgcgtgcttcgagtgacgcctccagcacctgcaacacaagatcagtgctgaccattgctttccagttctcatatgaaaatcacctacgagagagcgtcgcag

SEQ ID NO: 1003 - DNA, 256 bp, Zea mays
cagcaccagattgtctacaacaagctcaacagttccaccaacagctccagcagcagcaacagcagcagctacagcagttctgggtcgaacgcatgactgaaatcgaggcaacagctgatttcaggaaccacaacttgccacttgcgaggataaagaagatcatgaaggtcgacgaagatgtgcgcatgatctcagccgaagctcccgtggtcttcgcaaaagcttcgagatattcatactggagctgacgctgagg

SEQ ID NO: 1004 - DNA, 218 bp, Zea mays
cccacgcgtccgatctgtttgttgggtcacagatggtccctgatcgctggaaggctgccgggcaggaccgacaacgagatcaagaactactggaacacgcacatccggcggaagctgctgagcagggggatcgacccggtgacacaccgccccatcaacgagcacacgtccagcataaccatatcgttcgaggactggggccaggggaaggcgctcaa

SEQ ID NO: 1005 - DNA, 282 bp, Zea mays
gcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtgccaacataaccatatcgttcgacgactggggccaggggaaggcgctcaagtgccccgacctgaacctggacctctgca

SEQ ID NO: 1006 - DNA, 258 bp, Zea mays
tcatatctatagaggtcaacctcgaaggcatcttctgacaactggatggagttcatttatcaataagaagaaactagtctcaggggatgcagtcttgtttcttagaggtaatgatggtgagctaagattgggtgtgaggagagcagttcaactgaaaaatgaagctctacttgaagctgtcaactgtactgattcgaagctacttatgctgtctgctgtcgccaattctttggacaacagaagtatatttcacatctg

SEQ ID NO: 1007 - DNA, 274 bp, Zea mays
gccaaggatttgcatggcatgaaatggatgttacgtcatatctatagaggtcaacctcgaaggcatcttctgacaactggatggagttcatttatcaataagaagaaactagtctcaggggatgcagtcttgtttcttagaggtaatgattgtgagctaagattgggtgtgaggagagcagttcaactgaaaaatgaagctctacttaaagctgtcaactgtactgattcgaagctacttatgctgtctgctgtcgccaattctatggacaaca

SEQ ID NO: 1008 - DNA, 307 bp, Zea mays
taggcattgctgaacacatgggtcggacacttcaaacaacttcaatttccactaacataaacgaaacgctagacttctcttgtgctctctttggtccagatggtggccttgttgcaaatgcacctcatgtccctgtgcatctaggagccatgtctagtactgtttgttggcagcttaacttttggggtgagaacctcaatgagggtgatgttcttgtaacaaatcatccatgctctggggggagccatcttccagacataacagttgtcacgctagtgtttgatcacggtaagcttgtcttttttgt

SEQ ID NO: 1009 - DNA, 261 bp, Zea mays
aacagggcgatacagccctgtcgatctgttccttgttggatataagctggcactcctattgcagtgtcagcatcagtggactcgaacgccattatggcgttatccttgtgccacctttgtaacaagtagttcgttcttgttcttgaaccgtgtgttgtagttggccttggccgcatgctacctttgctctgtacggctgtgcctacaaagttgcggtggaacatgcagactcataataaagcatgcttgggctcttgtgat

SEQ ID NO: 1010 - DNA, 410 bp, Zea mays
  unsure (1)..(410): unsure at all n locations
aggcgtagcctcatgagggagagactcgtcaattcgccaaactccttcttcatggatgttaattgcaaggggtgcttcaccataaccacgtgttttcagccacccccaaacggttgttgtgtgccctggctgcaaaactgtcctctgccaacccacaggaggaaaggcaaggctcactgagggctgctctttccgcangaagggagactanagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgataattggtg

SEQ ID NO: 1011 - DNA, 284 bp, Zea mays
gtcgaactggcgcaaccgaccgccgccgcggctgcgttgaccaccgctgagcaggctcaggatctcatcgacgccgctagtatgacgacttggaggacgtcgtcgccctgttctccgctggtgtctcgctggactccacagattcgcaaggccgcacagctcttcacatggcttctgccaatggtcaccttgctatggtggaatacttgattcaaaatggagcgaatgttaatgccaccaacatggagaagaacacaccactccactgggcatgccttaatgga

SEQ ID NO: 1012 - DNA, 270 bp, Zea mays
gtcgaactggcgcaaccgaccgccgccgcggctgcggtgaccaccgctgagcaggctcaggatctcatcgacgccgctaggtacgacgacttggaggacgtcgtcgccctgttctccgctggtgtctcgctggactccacagattcgcaaggccgcacagctcttcacatggcttctgttaatggtcaccttgctgtggtggaatacttgattcaaaatggacgaatgttaatgccaccaacatggagaagaacacaccactccactggg

SEQ ID NO: 1013 - DNA, 273 bp, Zea mays
cgtcgaactggcgcaaccgaccgccgccgcggctgcggtgaccaccgctgagcaggctcaggatctcatcgacgccgctaggtatgacgacttggaggacgtcgtcgccctgttctccgctggtgtctcgctggactccacagattcgcaaggccgcacagctcttcacatggcttctgccaatggtcaccttgctatggtggaatacttgattcaaaatggagcgaatgttaatgccaccaacatggagaagaacacaccactccactgggc

SEQ ID NO: 1014 - DNA, 273 bp, Zea mays
  unsure (1)..(273): unsure at all n locations
gaactggcgcaaccgaccgccgccgcggctgcggtgaccaccgctgagcaggctcaggatctcatcgacgccgctaggtacgacgacttggaggacgtagtcgccctgttctccgctggtgtctcgctggactccacagattcgcaaggccgcacagctcttcacatggcttctgccaatggtcagcttgctgtggtggaatacttgattcagcatngagcgaatgttaatgccaccaacatggagaagaacacaccactccactgggcatgc

SEQ ID NO: 1015 - DNA, 408 bp, Zea mays
cccacgcgtccggaacaacgcgaccgccgccgtcgacgacgacgactcagctactcgcctggggatgggggtcgaactggcgcaaccgaccgccgacgcggctgcggtgaccaccgctgagcaggctcaggatctcatcgacgccgctaggtacgacgacttggaggacgtagtcgccctgttctccgctggtgtctcgctggactccacagattcgcaaggccgcacagctcttcacatggcttctgccaatggtcaccttgctgaggtggaatacttgattcaaaatggagcgaatgttaatgccaccaacatggagaagaacacaccactccactgggcatgccttaatggacgtatagaggtaatcagggctttgatctcagcgggggctagcgagagtgctct

SEQ ID NO: 1016 - DNA, 265 bp, Zea mays
cgcccaactcaccctgctccctgataagaagcaagatgagaatacatctgcaagagtggagaatgaggaggcagaggaggaggtggtgcctcatgtgccaccagccacaagtgaggggcttcgcatccattccttctgcaagacattgactgcctcagacacaagcacacatgggtggttctcagtgctgcgccggcatgcagatgagtgcctcccaccactggatatgagtcaaccatccccaaatcaagaatggtgggcaagg

SEQ ID NO: 1017 - DNA, 270 bp, Zea mays
ggtagttctcctgcgtcgtacgaaagaaactgtgatcaatggcaaaccaataataaatttacctcctaagacaattaatctgaataaagtagatttcacacaagatgagcggtcgttttatttgatgctggaagaacgctctcggcaacaattcaaggcatttgctgcggctgggacactcaaacaaaactatgccaacatccttttaatgttgctgcgacttcggcaagcctgtgatcatcctattcttgtaaagggcaatcagtcaga

SEQ ID NO: 1018 - DNA, 252 bp, Zea mays
ggtagttctcctgcgtcgtacgaaagaaactgtgctcaatggcaaaccaataataaatttacctcctaagacaattaatctgaataaagtagatttcacacaagaggagcgcaagtcttatttgatgctggaagaacgctctcggacaaaattcaaggcatttgctgcggctgggacactcaaacaaaactatgccaacatccttttaatgttgctgcgacttcggcaagcctgtgatcatcctattcttgt

SEQ ID NO: 1019 - DNA, 257 bp, Zea mays
tagtagttctcctgcgtcgtacgaaagaaactgtgatcaatggcaaaccaataataaatttacctcctaagacaattaatctgaataaagtagatttcacacaagaggagcggacgttttatttgatgctggaagaacgctctcggcaacaattcaaggcatttgctgcggctgggacactcaaacaaaactatgccaacatccttttaatgttgctgcgacttcggcaagccagtgatcatcctatcttgtaaaag

SEQ ID NO: 1020 - DNA, 251 bp, Zea mays
cagtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgc

SEQ ID NO: 1021 - DNA, 278 bp, Zea mays
ggattgtgggcgagtgcgtgcgttcgtgcagccacagacaggcgtccggccaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggacgggagcttctccaagaactt

SEQ ID NO: 1022 - DNA, 160 bp, Zea mays
tgggcgagtgcgtgcgttcgtgcagccacagacaggcgtccgggcaccatgtctttcaccggcacgcaggacaagtgcacggcgtgcgacgagaccgtccacttcatcgacctcctcacggccgacggcgccatctaccataagacatgcttcaagtgca

SEQ ID NO: 1023 - DNA, 275 bp, Zea mays
gatcgggattgtgggcgagtgcgtgcgttcgtgcacaagcgctgcacaccatgtctttcaccggcacgcaggacaagtgcacggcgtgcgacaagaccgtccacttcatcgacctcctcacggccgacggcgccatctaccataagacatgcttctagtgcagccactgcaaaggggtcctctcgatgtgcagctactcctccatggacggtgtgctgtactgcaagacccacttcgagcagctcttcaaggagaccgggagcttctccaagaac

SEQ ID NO: 1024 - DNA, 417 bp, Zea mays
cgggattgtgggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactc

SEQ ID NO: 1025 - DNA, 388 bp, Zea mays
agggcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgta

SEQ ID NO: 1026 - DNA, 382 bp, Zea mays
aggcgacagtgcgtgcgtgcagccacaggcaggcgtcggcaccatgtcttctttcaccggcacgcaagacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaatggcccccagcaggctatcatctgcgtattctggtactcaggataagtgtgcagcttgccagaaaaca

SEQ ID NO: 1027 - DNA, 452 bp, Zea mays
  unsure (1)..(452): unsure at all n locations
agggactagcgtccaacttgcangtgccggtctagaattcacggggccaaccaacccttcgagtgcgtgcgttcgtccatccacagacaggcgtccgggcacaatgtctttcaccggaacgcaggacaattgcagggcgtgcgacaagaccgtccacttcatcgacctcctcacggctgacagtgccatctaccacaagacatgcttcatgtgcagccactgcacatgggtcctcgcgatgtgcagctactcctccatggacgcgtgtgcctgtactgcatgagccacatcgagcagctcttcaaggagatcgggagcttctcacatgaacttcacgccacgtggcacgtcatcagacaatggtgaactgacaagggcgtcaagcaagctgtcgtctgcattttctggtagccaggataagtgcgcagcatgccagaaaacagtgtacccgc

SEQ ID NO: 1028 - DNA, 406 bp, Zea mays
actacgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctgg

SEQ ID NO: 1029 - DNA, 495 bp, Zea mays
  unsure (1)..(495): unsure at all n locations
ggcagaacgtcaccaggacggtactgtcccaaaattccntagtcgacccaggcctccgaccaggtggaaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacgggggctgcatcctcaccacctcctcctacgccgcgctcaacggcgttctgtactgcaagatccacttcgcgcagctgttcatggagaaggggagctacagccacatgatgaagaagagcccgtcccaggatacgctgccggacatggcagccgacgagcaaccgccggaaccggcgccaccgcaagacggggaaggagaggacaactangangaanggaccgccaccaatatatatcacacacacacacacacactcacac

SEQ ID NO: 1030 - DNA, 460 bp, Zea mays
  unsure (1)..(460): unsure at all n locations
gggcngcgcaggcatcatcggcagcccatcgacctaggtagcgcaggccgacccaagcctctacacagacgtcgtagtagagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtg

SEQ ID NO: 1031 - DNA, 409 bp, Zea mays
acggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacgggggctgcatcct

SEQ ID NO: 1032 - DNA, 436 bp, Zea mays
gggtctccagtacacatatatcggcctgtcgacgcactatctaggactcgcgggtcgatacaagcctctagaatgagtcgtaatagcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggat

SEQ ID NO: 1033 - DNA, 450 bp, Zea mays
ggggccggacgttcattcgcacggcagactcaatactaggactcgtaagacgatacacgcctctacagtcactcgtaggacgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctgggtaccaggataagtgcgcagcatg

SEQ ID NO: 1034 - DNA, 431 bp, Zea mays
ggcgctgcatgctaacatgcactgccgacgctatactaagacgcgtaggacgatacaagactctacaataattcgtgcgagcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagc

SEQ ID NO: 1035 - DNA, 408 bp, Zea mays
gggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtaccccgctggagaagttaact

SEQ ID NO: 1036 - DNA, 493 bp, Zea mays
ggggtcgcgtagcgtcaacctgcggctcgcgactaggactcacgggtcgacacacgcctctagcatccatcgtcatgcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgca

SEQ ID NO: 1037 - DNA, 398 bp, Zea mays
  unsure (1)..(398): unsure at all n locations
ggaggcgacagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgancaggggccccagcaagctatcatcctgcgtttctggtactcaggataagtgtgcagcttgccaganaacagtgttaccgctgga

SEQ ID NO: 1038 - DNA, 395 bp, Zea mays
aacgagagtgcgtgcgtgcagccacaggcaggcgtcggcaccatgtcttctttcaccggcacgcatgacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctgga

SEQ ID NO: 1039 - DNA, 364 bp, Zea mays
gtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaac

SEQ ID NO: 1040 - DNA, 342 bp, Zea mays
gcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgtttt

SEQ ID NO: 1041 - DNA, 418 bp, Zea mays
caacgcgtccgcggacgcgtgggcgggaggcgagagtgcgtgcgtgcagccacaggcaggcgtcggcaccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggccccagcaagctatcatctgcgttttctggtactcaggataagtgtgcagcttgccagaaaacagtgtacccgc

SEQ ID NO: 1042 - DNA, 473 bp, Zea mays
  unsure (1)..(473): unsure at all n locations
gagaagcgatcgggattgtgggcgagtgcgtgcgttcgtgcagccacagacaggcgtgcgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccaganaacagtgtacccgctggagaagttaactctggaaggcgagtcctaccacangagctgcttcaagtgctcgcacgg

SEQ ID NO: 1043 - DNA, 470 bp, Zea mays
cggacgcgtgggcggacgcgtgggtcgggattgtgggcgagtgcgtgcgttcgtgcagccagagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagtttactctggaaagccagtcctaccacaagagctg

SEQ ID NO: 1044 - DNA, 420 bp, Zea mays
gatcgggattgtgggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaaggtaactc

SEQ ID NO: 1045 - DNA, 400 bp, Zea mays
cccacgcgtccgcccacgcgtccggtgcgtgcgttcgtgcagtcacagacaggcgtccgggcaccgtgtctttcaccggcacgcaggacaagtgcacggcgtgcgacaagaccgttcacttcatcgacctcctcacggacgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaagataagtgcgcagcatgccagaaaac

SEQ ID NO: 1046 - DNA, 464 bp, Zea mays
  unsure (1)..(464): unsure at all n locations
cccacgcgtccgcgggaggcgagagtgcgtgcgtgcagccacaggcaggcgtcggcgccatgtcttctttcaccggcacgcaggacaagtgcgcggagtgcgacaagaccgtccacttcatcgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgctgcttgccagaaaacagtgtacccgctggagaagttaactctggaaggcgagtcctaccacangagctgcttcaagtgctcg

SEQ ID NO: 1047 - DNA, 441 bp, Zea mays
cccactcgtccgtccactcgtccgattgtgggcgagtgcgtgcgttcgtgcagccacagagaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagataacagtgtacccgctggagaagttaactctgga

SEQ ID NO: 1048 - DNA, 394 bp, Zea mays
gggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgct

SEQ ID NO: 1049 - DNA, 508 bp, Zea mays
  unsure (1)..(508): unsure at all n locations
tgttggatggtctcgatacaatgcccaccngtanngcatttcgttccttaattcccgtatcgggccgagcgacaccagcagccacacctcccgcatgacaccactgaccgcttgtcttccaggagaccgggagcttctgcaagaactttacgccacgtggcaagtcttcagacacgggtgaactgacacagggcccccagcaagctatcatctgcgttttctggtactcatgataagtgtgcatcttgccataaaacagtgtacccgctggagaagttaactctggaaggcgagtcctaccacaagagctgcttcaagtgctcgcacgggggctgcatcctcaccaccttctcctacgccgcgctcaacggcgttctgtactgcaagatccacttctcgcatctgttcatggataatgggagctacatccacatgatgaataagagcccgtcccaatatacacttccggacatggccgtcgactagcaaccgccggaaccggcgccac

SEQ ID NO: 1050 - DNA, 452 bp, Zea mays
  unsure (1)..(452): unsure at all n locations
cccacgcgtccggcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacgggggctgcatcctcaccacctcctcctacgccgcgctcaacggcgttctgtactgcaagatccacttcgcgcagctgttcatggagaaggggagctacagccacatgatgaagaagagcccgtcccaggatacgctgccggacatggccgncgacgagcaaccgncggaaccggcgccaccgcaagacggggaaggagaagacaac

SEQ ID NO: 1051 - DNA, 454 bp, Zea mays
  unsure (1)..(454): unsure at all n locations
cccacgcgtccgtccacgcgtccgacctcctcacggccgacggcgtcacctaccataagacatgcttcaagtgcagccactgcaaagggatcctctcgatgtgcagctactcttccatggacggtgtgctgtactgcaagacccacttcgagcagctcttcaaggagaccgggagcttctccaagaacttcacgccaggtggcaagtcttcagacaagggtgaactgacaagggcccccagcaagctatcatctgcgttttctggtactcaggataagtgtgcagcttgccagaaaacagtgtacccgctggagaagttaactctggaaggcgagtcctaccacaagagctgcttcaagtgctcgcacggnggctgcatcctcaccaccttctnctacgccgcgctcaacggcgttctgtactgcaagatccacttcgcgcagctggtcatgga

SEQ ID NO: 1052 - DNA, 250 bp, Zea mays
gtcagagagagctgaaagggcaactcttgttacccaggagaaacttcagattggaagcaacagaatgaagatgatgaggctttctgatgtgtggatacgacctgcatttggtggtcgtgggaggaagctcacaggaaatcttgaggctcatttcaatggtttcagatattctacttcaaggtctgatgagcgtgtggacatcatgtttggaaatataaagcatgcctttttccagcctgcagagaaagaa

SEQ ID NO: 1053 - DNA, 297 bp, Zea mays
gctgaaagggcaactcttgttacccaggagaaacttcagattggaagcaacagaatgaagatgatgaggctttctgatgtgtggatacgacctgcatttggtggtcgtgggaggaagctcacaggaaatcttgaggctcatttcaatggtttcagatattctacttcaaggtctgatgagcgtgtggacatcatgtttggaaatataaagcatgcctttttccagcctgcagagaaagaaatgattactctccttcacttccatttgcacaaccatatcatggttggaaacaagaag

SEQ ID NO: 1054 - DNA, 196 bp, Zea mays
cggacgcgtgggtggctatctcgtctacttattatgataagctggcaacatacatgcgggatatatttagtataactgcaaaagctgtgaggggagatgaggagtcagttgcgctccaggctattgaattctggagttccatatgtgatgaggaaatcgacattctggatgagtacagcagtgaatttacagctga

SEQ ID NO: 1055 - DNA, 266 bp, Zea mays
gtttgtgaagcgacacagtctccagatgtgaagataaggcaggctgcttttgagtgtttggtggctatctcgtctacttattatgataagctggcaacatacatgcgggatatatttaatataactgcaaaagctgtgaggggagatgaggagtcagttgcgctccaggctattgaattctggagttccatatgtgatgaggaaatcgacattctggatgagtacagcagtgaatttacagctgattctgatgttccttgctacta

SEQ ID NO: 1056 - DNA, 426 bp, Zea mays
aagtccaatccatttctctttctgctgcttgtgatttgttcatgcggtttgtaacgaggacctcacatctggagcatgagaagtttgatgcagcacaatcgcggctaattgagcgaggagaaaaatttggggagatatctttaaaggctcgcaagacaattgcaatgcttagtcaagattttatttatgatgggtgtactatacttgtccatgggtagtccagagtagtactggaagttctaaagcttgctgcatccaatcgcaagctcttccgggtactatgcagagagggcagggcagacagaattggtttaaggatgtcagatgaacttgcagcatgtaaggatcgctgttaagggtcgaattgatgtagctggttgcgtagtccattgatgaagttgacatggggttttgttggcgctgatg

SEQ ID NO: 1057 - DNA, 261 bp, Zea mays
gcctcctcaaatttctgaccacgagctagaggagatagcaaagatgggcagtgctggtgatcctgctttagctgatgagcttggtgaaggaagcactgccacaagaaccttgcttgccagctattctcagactccaaggcttggtatgacaccattgcgaactccgcagcgaactccagctgggaagggtgatgcaatcatgatggaggcagaaaatcttgcacgtctcagagaatcacaaacgcctttattaggaggtga

SEQ ID NO: 1058 - DNA, 309 bp, Zea mays
gcaaagatgggcagtgctggtgatcctgctttagctgatgagcttggtgaaggaagcactgccacaagaaccttgcttgccagctattctcagactccaaggcttggtatgacaccattgcgaactccgcagcgaactccagactgggaagggtgatgcaatcatgatggaggcagaaaatcttgcacgtctcagagaatcacaaacacctctattaggaggtgataacccagagcttcatccatcagatttctctggtgttacaccacgcaagaaggagatacagactccaaatccaatggcaacacc

SEQ ID NO: 1059 - DNA, 238 bp, Zea mays
ggccgaggaggaccgatccaaggtcgacgacctccgacgcacgcccatgagcgtcggatccctcgaggagatcatcgacgagagccacgccatcgtctcctcctccgtcggacccgagtactatgtcggcatcctctccttcgttgacaaggaccagctcgagccggggtgctccatcctcatgcacaacaaggttctctctgtggttggtatattgcaagatgaagttgatcctatg

SEQ ID NO: 1060 - DNA, 290 bp, Zea mays
  unsure (1)..(290): unsure at all n locations
gggaacgcctccgtccccaggaagacaaggccgaggaggaccgatccaaggtcgacgacctccgcggcacccccatgagcntcggatccctcgaggagattatcgacgagagccacgccatcgtctcctcctctgtccggacccgagtactatgtcagcatcctctcctttgtcgacaaggaccagctcgagccgggatgctccatcctcatgcacaataaggttctttctgtagttggtatattgcaagatgaagttgatcctatggtatctgtnatgaaaattganaa

SEQ ID NO: 1061 - DNA, 304 bp, Zea mays
atcatctttattgatgaaattgagcccatcggaacaaagcgttttgactgtgaagttagtggcgatagagaagtgcaaaggacaacgttggaattgctgaatcagcttgatggatttagcagcgatgagaggataaaggtgatagctgcaacaaatcgtgctgatattcttgatcctgctctgatgagatctggtcgtctggagcgtaagattgagttccctcatccatcagaggaagcaagagctagaatcctgcagatccactcgaggaaaatgaatgtgaatccagatgtcaactttgaag

SEQ ID NO: 1062 - DNA, 222 bp, Zea mays
caaagcgttttgacagtgaagttagtggcgatagagaagtgcaaaggacaatgttggaattgctgaatcagcttgatggatttagcagcgatgagaggataaaggtgatagctgcaacaaatcgtgctgatattcttgatcctgctctgatgagatctggtcgtctggaccgtaagattgagttccctcatccatcagaggaagcaagagctagaatcctgc

SEQ ID NO: 1063 - DNA, 314 bp, Zea mays
ctggaccggaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaaggggggaacgccccgtacttggtgatcattcagtt

SEQ ID NO: 1064 - DNA, 289 bp, Zea mays
gcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaagggggggaacgcccggtacttggtgatcattcagttgtttgtgacactgccattgtctgggcaggctaacttactatttgtactataagcaagctgttgcttttgtgtcttactccgtatg

SEQ ID NO: 1065 - DNA, 435 bp, Zea mays
ggaccgtagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaagggggggaacgcccggtacttggtgatcattcagttgtttgtgacactgccattgtctgggcaggctaacttactatttgtactataagcaagctgttgcttttgtgtcttactccgtatgagagtatcatttatgaaatattaaccaagtctgcctgc

SEQ ID NO: 1066 - DNA, 426 bp, Zea mays
gcatcatctttattgatgaaattgatgccattggaacaaagcgttttgacagtgaagggagtggcgatagagaagtgcaaaggacaatgttggaattgctgaatcagcttgatggatttagcagcgatgagaggataaaggtgatagctgcaacaaatcgtgctgatattcttgatcctgctctgatgagatctggtcgtctggaccgtaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgagg

SEQ ID NO: 1067 - DNA, 292 bp, Zea mays
cggacgcgtgggagagagaggacatagccgcacaaagggaaggataccctcgccaacctcgaagctagtccaaactagtgggaggttgaactcagggatcgatcggggaagacgagacaagcttcttctgctgctgctgccgcccccgccagctctagttcaccagagttactacttactagccaatctgacaccgatccaccgccggcaccgaccgtccatggcgcggggcaaggtgcagcttcggcgcgtcgagaacccggtgcaccggcaggtgacattctgcaagcgc

SEQ ID NO: 1068 - DNA, 299 bp, Zea mays
caggacatagccgcacaaagggaaggagaccctcgccaacctcgaagctagtccaaactagtgggaggttgagtgcagggatcgatcgaggaagacgagacaagcttcttcttctgctgccgccgccgccagctctagctcaccacgagttactagccaatctgacaccgaccgtccatggcgcggggcaaggtgcaacttcggcgcgtcgagaacccggtgcaccggcaggtgacattctgcaagcgccgcgctgggctgctcaagaaggcccgggagctctccgtcctctgcgacgc

SEQ ID NO: 1069 - DNA, 253 bp, Zea mays
gccgcacaaagggaaggagaccctcgccaacctcgaagctagtccaaactagtgggaggttgagtgcagggatcgatcgaggaagacgagacaagcttcttcttctgctgccgccgccgccagctctagctcaccacgagttactagccaatctgacaccgaccgtccatggcgcggggcaaggtgcaacttcggcgcgtcgagaacccggtgcaccggcaggtgacattctgcaagcgccgcgcggggctgc

SEQ ID NO: 1070 - DNA, 277 bp, Zea mays
cggacttcatcaagctgaagcacaaggcttgggcactccagaagagcacaaccatgtaccaaccttctacctaaaggtgctgcttgcagccttggatatttgcggatgcggagtgaagttaccatggcatcgttgctaagaataagaaagtaatgtggttatgaggagatgtgtaattttgtggcgatattatttgcaacaatgatgtatatatgggcatgtttggttcacggctaactgtgacacactttgcctaaggttagtcgttcgaattgaa

SEQ ID NO: 1071 - DNA, 274 bp, Zea mays
atttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaatctgatccaaatagctggctcaagtatactgtggctcctgcaatgcagccttgattagtagatccttacctgca

SEQ ID NO: 1072 - DNA, 299 bp, Zea mays
catggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaat

SEQ ID NO: 1073 - DNA, 205 bp, Zea mays
  unsure (1)..(205): unsure at all n locations
gtttcctcagtggactagtgtgaagctgtgcttagcgtagtnaacgggaggaaggacaaggcaaggcaactgatggcggcgggcggcggaggcggctcgccggcgccgttcgtgtggaagacgtacacgatggtggaggaccccgggacggcaggggtgatcggctggggcagcggcaacaacagcttcgtcgtcgccgacccct

SEQ ID NO: 1074 - DNA, 207 bp, Zea mays
gtgtttcctcagtggactagtgtgaagctgtgcttagcgtacggatagggaggaaggacaaggcaaggcaactgatggcggcgggcggcggaggcggctcggcggcgccgttcgtgtggaagacgtacacgatggtggaggaccctgggacggcaggggtgatcggctggggcagcggcaacaacagtttcgtcgtcgccgacccct

SEQ ID NO: 1075 - DNA, 293 bp, Zea mays
tcagctcaggccttctcaagagctggttgccaaggatttgcatggagccaagtggaaatttcgtcatatatataggggtcagcctcgtaggcatctcttgactactggatggagttcatttgtcaataaaaagaaactggtttctggggatgcggtcttatttctccgaggtgatgatggtgaactaaggctgggcgtacggagggccattcagcttaaaaatgaggccctttttgacgatttcagttgcgacagtacaaaacggcatacattgttggctgtagctgattcct

SEQ ID NO: 1076 - DNA, 312 bp, Zea mays
agaatttgagcattgtagaactgaacagcagttctttgtcctgcctctctcttgctggttgccgctcgatgacattgttaagactctcatgcccaaatctgcaacatgtcaatcttgatggctgtgatcaccttcaaagtgcagcattctgtccagtgggtctcgaatccctaaatctgggaatttgtccaaaactgagtgttcttcacattgaggctccaaatatgtctatattggagctgaagggttgtggtgtgctttccaaggcttccatcaattgccctcgcttgacttcgttggatgcctctttct

SEQ ID NO: 1077 - DNA, 267 bp, Zea mays
gccttctcgtcgctcctgttcttctcgcatccccagcccaggtggtgtcccctgtcgcgttgatgcatgctccctcggcggtggccttgagctgaggcggcggagcgatgccggactcggacaacgactccggcgggccgagcaacgccgggggcgagctgtcgtcgccgcgggagcaggaccggttgctgcccatcgccaacgtgagccggatcatgaagaaggcgctcgcggccaacgccaagatcagcaaggacgccaaggaga

SEQ ID NO: 1078 - DNA, 290 bp, Zea mays
cgacgcagagactcgccaaatttcccaccctcctcctagccttctcgtcgctcctgttcttctcgcatccccagcccacgatgtgtcccctgtcgcgttgatgcatgctccctcggcggtggccttgagctgaggcggcggagcgatgacggactccgacaacgactccggcgggccgagcaacgccgggggcgagctgtcgtcgccgcgggagcacgaccggttcctgcccatcgccaacgtgagccggatcatgaagaaggcgctcccggccaacgccaacatcagca

SEQ ID NO: 1079 - DNA, 418 bp, Zea mays
atagccttctcgtcgctcctgttcttctcgcatccccagcccaagtggtgtcccctgtcgcgttgatgcatgctccctcggcggtggccttgagctgaggcggcggagcgatgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtccagccgct

SEQ ID NO: 1080 - DNA, 346 bp, Zea mays
  unsure (1)..(346): unsure at all n locations
cagcagttgaagggcaaactaaaagtgatggagcatatgccaggtgatgaagattcagcgtcaaagaataaaattaatgagctgagtgaggcattgcaagaaaagatagatgaactggatggaatggagtcacttaaccaaactctggttatcaaagaaagcaaaagcaacattgaactgcaagaagctcgcaaagagctagaaaatggcctgcttgatctttcaggtgggcagacacatataggaatcaagagaatgggagagcttgatctanaagcattttcanaggcatgccanaaggagcgtacagaaaatgcagaagttactgctgcctttctttgttcaa

SEQ ID NO: 1081 - DNA, 316 bp, Zea mays
ggcattgcaagaaaagatagatgaactggatggaatggagtcacttaaccaaactctggttatcaaagaaagcagaagcaacattgaactgcaagaagctcgcaaagagctagaaaatggcctgcttgatctttcaggtgggcagacacatataggaatcaagagaatgggagagcttgatctaaaagcattttcaaaggcatgccaaaaggagcgtacagaaaatgcagaagttactgctgcctttctttgttcaaagtgggaggctgaaataaaaaatcctgactggcacccttttaaggtcgtcacaattgat

SEQ ID NO: 1082 - DNA, 250 bp, Zea mays
ggacactgctggagagggtgagagctagggagcagcggtcgggcagccatggggcaccactgctgcagcaagcagatggtgaagcgtgggctgtggtcgccggaggaggacgagaagcttgtcaagtagatcagcgcccacggccacagctgctggagcgccgttcccaagcatgccgggctgcagcgctgcggcaagagctgccgcctccggtggatcaactacctccggccggacctgaagcgcggaa

SEQ ID NO: 1083 - DNA, 214 bp, Zea mays
gagaagttcagcggacaatgttggaattattgaatcaactggatggattcagcagcgatgagagaataaaggtcatagctgcaactaaccgtgctgacatccttgaccctgctctgatgcgatctggacggttggaccgaaagattgagttccctcacccatccgaagaagcaagagctagaatcttgcaaatccattcaagggaaatgaatgt

SEQ ID NO: 1084 - DNA, 273 bp, Zea mays
gagaagttcagcggacaatgttggaattattgaatcaactggatggattcagcagcgatgagagaataaaggtcatagctgcaactaaccgtgctgacatccttgaccctgctctgatgcgatctggacggttggaccgaaagattgagttccctcacccatccgaagaagcaagagctagaatcttgcaaatccattcaaggaaaatgaatgtaaatcctgatgtcaactttgaagaattggctcgctcaactgatgacttcaacggagcac

SEQ ID NO: 1085 - DNA, 418 bp, Zea mays
cggacgcgtgggcggacgcgtgggcggacgcgtggggggatgcattccagcttgcgcgaagagaaagctccttgtattatatttattgatgagatagatgccattggcaccaaacgttttgatagtgaagttagcggtgatagagaagttcagcggacaatgttggaattattgaatcaactggatggattcagcagcgatgagagaataaaggtcatagctgcaactaaccgtgctgacatccttgaccctgctctgatgcgatctggacggttggaccgaaagattgagttccctcacccatacgaagaagcatgagctagaatcttgcaaatccattcaaggaaaatggatggaaatcctgatgtccaccttgaagaattggctcgctcaactgatgacttcaacggagcacagc

SEQ ID NO: 1086 - DNA, 404 bp, Zea mays
caaacgttttgatagtgaagttagcggtgatagagaagttcagcggacaatgttggaattggtgaatcaactggatggattcagcatcgatgagagaataaaggtcatagctgctactaaccgtgctgacatccttgaccctgctctgattcgatctggacggttggaccgaaagattgagttccctcacccatccgaagaagcatgagctagaatcttgcaaatccattcaaggaaaatgaatgtaaatcctgatgtcaactttgaagaattggctcgctcaactgatgacttcaacggaacacagctaaaggcaatttgtgtagaagctggtatgcttgccctacggcgggttgctacagatgtaactcacgaggttttcaatgaatggatcgtacaggttc

SEQ ID NO: 1087 - DNA, 306 bp, Zea mays
actaggcggcgcatcttccagatacacacatcgaaaatgacactggctgatgatgtaaacctagaagagtttattatgtcaaaagatgagttttcaggtgctgacatcaaggccatttgtactgaagctggcttgcttgctttgagagagcggcggatgaaggtaacgcatgcagacttcaagaaggccaaagaaaaggttatgttcaagaagaaagaaggcgtgccggagggcctatatatgtgagactcatcagcagcgctattagtctttgtgagagaactggcgtttgtaatctgcttaaat

SEQ ID NO: 1088 - DNA, 228 bp, Zea mays
ggtggctgatgatctttctccttcaattgtctttattgatgagattgatgctgttgggacaaagaggtacgatgctcattctggtggcgagcgtgagattcagagaaccatgttggagttgttaaatcagctggatggttttgattcaagaggagatgttaaagttattctagcaacaaatcgtattgagagtcttgatccagccttgcttcgcccaggtcgaattga

SEQ ID NO: 1089 - DNA, 196 bp, Zea mays
gtgagattcagagaaccatgttggagttgttaaatcagctggatggttttgattcaagaggagatgttaaagttattctagcaacaaatcgtattgagagtcttgatccagccttgcttcgcccaggtcgaattgacagaaagattgattccctttacctgatgtcaagactaggcggcgcatcttccagatacac

SEQ ID NO: 1090 - DNA, 238 bp, Zea mays
tcgaaaatgacactggctgatgatgtaaacctagaagagtttattatgtcaaaagatgagttttcaggtgctgacatcaaggccatttgtactgaagctggcttgcttgctttgagagagcggcggatgaaggtgacgcatgcagacttcaagaaggccaaagaaaaggttatgttcaagaagaaagaaggcgtgccggagggcttatatatgtgagactcatcagcagcgctattag

SEQ ID NO: 1091 - DNA, 237 bp, Zea mays
ggatggctttgattcaagaggagatgttaaagttattctagcaacaaatcgtattgagagtcttgacccagccttgctttgcccaggtcgaattgacagaaagactgaattcgctttacctgatggcaagactaggcggtgcattttccagatacacacatcgaaaatgacactggctgctgatgtaaacctagaagagtctattatgtcaaaagatgagttttcaggtgctgacat

SEQ ID NO: 1092 - DNA, 336 bp, Zea mays
ctcgttcaattgtctttattgatgagattgatgctgttgggacaaagaggtacgatggggattctggtggcgagcgtgagattcagagaaccatgttggagttgttaaatcagctggatggttttgattcaagaggagatgttaaagttattctagcaacaaatcgtattgagagtcttgatccagccttgcttcgcccaggtcgaattgacagaaagattgaattccctttacctgatgtcaagactaggcggcgcatcttccagatacacacatcgaaaatgacactggctgatgatgtaaacctagaagagtttattatgtcaaaagatgagt

SEQ ID NO: 1093 - DNA, 429 bp, Zea mays
tcggatggtcccaagcttgttagagaattgttcagggtggctgatgatctttctccgtcagttgtctttattgatgagattgatgctgttgggacaaagaggtacgatgctcattctggtggcgagcgtgagattcagagaaccatgttggagttgttaaatcagctggatggttttgattcaagaggagatgttaaagttattctagcaacaaatcgtattgagagtcttgatccagccttgcttcgcccaggtcgaattgacagaaagattgaattccctttacctgatgtcaagactaggcggcgcatcttccagatacacacatcgaaaatgacactggctgatgatgtaaacctagaagagtttattatgtcaaaagatgagttttcaggtgctgacatcaaggccatttgtactgaagctggc

SEQ ID NO: 1094 - DNA, 460 bp, Zea mays
agtggtcacctgctgcacaggcccgagactcgcgagtcgacacacgcctccgggatatgtcaaagtaattctagcaacaaatcgtattgagagtcttgatccagccttgcttcgcccaggtcgaattgacagaaagattgaattccctttacctgatgtcaagactaggcggcgcatcttccagatacacacatcgaaaatgacactggctgatgatgtaaacctagaagagtttattatgtcaaaagatgagttttcaggtgctgacatcaaggccatttgtactgaagctggcttgcttgctttgagagagcggcggatgaaggtgacgcatgcagacttcaagaaggccaaagaaaaggttatgttcaagaataaagaaagggtgccggagggcttatatatgtgagactcatcagcagcgctattaggtcttagtgagagaactggcgtttgtaat

SEQ ID NO: 1095 - DNA, 216 bp, Zea mays
gcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggacctg

SEQ ID NO: 1096 - DNA, 302 bp, Zea mays
aaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggattagcagcgcaacctccagtctccaccggaggcgccaccggacctgaaccgctgtgtccctccttggccgcgtagctgccggcaccgagcaatgacatggacgtggagacgga

SEQ ID NO: 1097 - DNA, 172 bp, Zea mays
caactagcacagcagttcaaacaagtctcatcaatgagtgcatatggcatggtcatctgctgctgttgatgctgaagttgttgctggtttagttgctgttgctgttgctgttgaaggtgctgctgctgattaatctgctgtagttggctgctgcctagttctagatcgcact

SEQ ID NO: 1098 - DNA, 280 bp, Zea mays
cagagaaacacatggcagcagcagcagtgaagtcgtcggccgggatggcggggaagaagtcccggaagccgtacgtggtgagcaggccgcgggagaagtggaccgccgacgagcacggccgcttcctccacgcgctgctgctgttcggccgcgactggaagagggtccaggcgttcgtcgccaccaagacgggcacgcagatacgcagccacgcccagaaacacttcctcagagcggacaagaagctgggcctcgccgtgccgccgcggcaccctcaccg

SEQ ID NO: 1099 - DNA, 244 bp, Zea mays
gcagtgaacaagtcgtcggccgggacgaagaagtcccggaagccgtacgtggtgagcaggccgcgggagacgtggaccgccgacgagcacggccgcttcctccacgcgctgctgctgttcggccgcgactggaagatggtccatgcgttcgtcgccaccaagacgggcacgcagatacgcagccacgcccagaagcactttctcagagcggacaagaagctgggcctcgccgtgccgccgccgg

SEQ ID NO: 1100 - DNA, 243 bp, Zea mays
gcagtgaacaagtcgtcggccgggacgaagaagtcccggaagccgtacgtggtgagcaggccgcgggagacgtggaccgccgacgagcacggccgcttcctccacgcgctgctgctgttcggccgcgactggaagatggtccatgcgttcgtcgccaccaagacgggcacgcagatacgcagccacgcccagaagcactttctcagagcggacaagaagctgggcctcgccgtgccgccgccg

SEQ ID NO: 1101 - DNA, 251 bp, Zea mays
cttcgttgcctctcttcctccctctcctctcttccttcctctcgatcgatcgtcatagcaatccaagctagcaagcccgtccgtcgtctctcgtccaagaagcatacaactactaatggggaggtcaccgtgctgcgaccaggacgcgggcaccaagaaaggcccgtggacgccggaggaggacaagctgctggtggactacatcaacggcaacggccacgggagctggcgccgcctgcccaagcacgccg

SEQ ID NO: 1102 - DNA, 338 bp, Zea mays
cgttgggctaccccaactcacaagcttcagatgcttcgcaattgatttctcaagcttcctttgatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctg

SEQ ID NO: 1103 - DNA, 440 bp, Zea mays
ggtctcttgaattgtttttacaagatttaattgaccgtacttatgaaattactcttgaaagtggagcaaagacactgaattccttccacctgaagcaatgtgtgaagaggtacagttcttttgatttcctaactgaagttgtcagcaaggtacctgatcttggtggcgctgattcctgtggagatgaaagaggattacctagaagaagaaagtcaaatggctgtgacccagagaatgatgaatcaagatctagtaaaatggccataagaaatgcatacatcagccccagaggacgtgggaggggtcgaggcataggacgaggtctgccaccaaccaagagaaaggaggttggttatgtacaatttgaagatgagagcagcatgtttgctgaacatggtgagcccttgccaggagaggatacagttcaagagatcaatggc

SEQ ID NO: 1104 - DNA, 288 bp, Zea mays
aagaccttgaagcaaataagatcaagaaagactcaggtgttacttgatgaactttgcgacttaaagagaaaggaacaaatgctgcaagacgctaacagggttctgaaaaggaagctgcacgagtttgatgcagaggctgcttctcccccacaattggcgtggcaaggcggaggcggcatgttgtcccatgaccctccacagccagaacacttcttcgtggctctggagagcaacgcgcctctgcaacctacataccatactatggacatgaaccagcagccagagcca

SEQ ID NO: 1105 - DNA, 352 bp, Zea mays
cccacgcgtccgcccacgcgtccgagcaaataagatcaagaaagactcaggtgttacttgatgaactttgcgacttaaagagaaaggaacaaatgctgcaagacgctaacagggttctgaaaaggaagctgcacgagtttgaggcagaggctgcttctcccccacaattggcgtggcaaggcggaggcggcatgttgtcccatgaccctccacagccagaacacttcttcgtggctctggagagcaacgcgcctctgcaacctacataccatactatggacatgaaccagcagccagagccagcgccgggcggctgctacccttctgcgtggatggcttagccagcgctttg

SEQ ID NO: 1106 - DNA, 455 bp, Zea mays
ggcacatctatgcttcagctgatgctgcagtgccatctagcgatgagatgcagaataactatcaagaatatgtgaagctgaaagcacgagttgaggttttacaacactcgcaaaggaatcttcttggtgaagaactggctccacttagcccaagtgaacttgaccagcttgagagtcaagtagacaagaccttgaagcaaataagatcaagaaagactcaggtgttacttgatgaactttgcgacttaaagagaaaggaacaaatgctgcaagacgctaacagggttctgaaaaggaagctgcacgagtttgaggcagaggctgcttctcccccacaattggcgtggcaaggcggaggcggcatgttgtcccatgacccttcacagccagaacacttcttcgtggctctggagagcaacgcgcctctgcaacctacataccatactatggacatg

SEQ ID NO: 1107 - DNA, 239 bp, Zea mays
atcagcaagatggaccggacgtcgatcctgggcgacacgatcgactacatgaaggagctgctggagaggatcaagctgctgcaggaagagatcgggcagcagcaggaggaggcgccaggcatgctcagcgtcttccgggagctcaaccccaacgagatggtggccaggaacacccccaagttcgacgtggagcggaaggagggcggcgacacccgggtggagatctactgcgccgccaa

SEQ ID NO: 1108 - DNA, 275 bp, Zea mays
gcaagatggaccggacgtcgatcctgggcgacacgatcgactacatgaaggagctgctggagaggatcaagctgctgcaggaagagatcgggcagcagcaggaggaggcgccaggcatgctcagcgtcttccgggagctcaaccccaacgagatggtggccaggaacacccccaagttcgacgtggagcggaaggagggcggcgacacccgggtggagatctactgcgccgccaagccggggctgctgctgtccacggtgagcacgctggacacg

SEQ ID NO: 1109 - DNA, 266 bp, Zea mays
acgctccgtcgtgcccaagatcagcaagatggaccggacgtcgatcctgggcgacacgatcgactacatgaaggagctgctggagaggatcaagctgctgcaggaagagatcgggcagcagcaggaggaggcgccaggcatgctcagcgtcttccgggagctcaaccccaacgagatggtggccaggaacacccccaagttcgacgtggagcggaaggagggcggcgacacccgggtggagatctactgcgccgccaagccggggc

SEQ ID NO: 1110 - DNA, 287 bp, Zea mays
ctgccttttcctagcgtgcttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaatgcgtacgagctctccgtcctctgcgacgctgaggtggccctcatcgtcttctctagccgtggtcgcctctacgagtatgccaacaacagtgtcaccgctactgttgagaggtaaaga

SEQ ID NO: 1111 - DNA, 422 bp, Zea mays
  unsure (1)..(422): unsure at all n locations
cccacgcgtccgggaacaagctgagatctccagcatggggaggggaaggattgagatcaagaggatcgagaacaacacgagccggcaggtcaccttctgcaagcgccgcaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctctggccccccactcttagagcacaatgcccagcaattctaccagcaagaatccgcaaaactgcgcaaccagatccaaatgctgcaaaacactaacaggcacttggttggtgactctgtgngaaacttgtcactcanagagctgaagcagctgg

SEQ ID NO: 1112 - DNA, 426 bp, Zea mays
cttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcac

SEQ ID NO: 1113 - DNA, 426 bp, Zea mays
cccacgcgtccgtgctttctatatctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcactcaaggagctgaaacagc

SEQ ID NO: 1114 - DNA, 316 bp, Zea mays
cccacgcgtccgcgcagctccaactactcacaagaagtaaaaactccactggacactgaaattaactaccaggattatctcaagttgaggacaagggtcgaattcctccaaactacacaaagaaatattcttggcgaggatctgggtccgcttagcatgaaggagctagagcagctggaggaccaaatagagatatctctgaagcatatcagctcaagaaagaatcaaatgctacttgaccagctatttgatctcaaaagcaaggaacaagaattgctggatctcaataaagacctaaggaagcagctgcaagaaa

SEQ ID NO: 1115 - DNA, 430 bp, Zea mays
cccacgcgtccggatttctaaagtaggtcagtggtactggattcttttttttaaaaaaaagtatatgctattttctattttctttagaactaggtttgtcggtttgtttggcaaacacgatctatgtactgacctgaactttgtgtattccctttttccaagcaggatctcacgttgacttactctgtttcgttgcgctctttcttttcaaaactagattaactaccaggattatctcaagttgaggacaagggtcgaattcctccaaactacacaaagaaatattcttggcgaggatctgggtccgcttagcatgaaggagctagagcagctggaggaccaaatagagatatctctgaagcatatcagctcaagaaagaatcaaatgctacttgaccagctatttgatctcaaaagcaaggaacaagaa

SEQ ID NO: 1116 - DNA, 297 bp, Zea mays
  unsure (1)..(297): unsure at all n locations
aaaaactccactggacactgaaattaaataccaggattatctcaagttgaggacaaggggtgaattccttcaaactacacaaagaaatattcttggggaggatctgggtccacttagcatgaaggagctcgagcagctggaggaccaaatagagatatctctgaagcatatcagctcaagaaagaatcaaatgctacttgatcagctctntgacctcaaaagcaaggaacaagaattgctggatctcaataaagacctaaggaagcaactgcaagagacaaggccagagaacgcgct

SEQ ID NO: 1117 - DNA, 287 bp, Zea mays
gtggaaggccgtgaagatcctgacaggggcgtgcagcctcagccactgactcaggattttttgatgatgtcttctgggaaacgcaagacggatgagtatcctggtcagctcccttctggttcttttgtaccacaacaagatggaagtgctgatcagatagtagaatttgttgtgtcaaaggaaaatgcgaatcaactttggagttccatcggcaataagcttgaaacaccaaccaagacaataactccagttattccgcagcgtgatgggattcaagataactacaa

SEQ ID NO: 1118 - DNA, 302 bp, Zea mays
ggatggcaataaatggggcagacccaacagctggtcatccaagtccctacatgccaccaccttccccttggatgaatcagaggccgctgggtgttgatgtgaatgtcgcttatgtggaaggccgtgaagatcctgacaggggcgtgcagcctcagccactgactcaggattttttgatgatgtcttctgggaaacgcaagagggatgagtatcctggtcagctcccttctggttcttttgtaccacaacaagatggaagtgctgatcagatagtagaatttgttgtgtcgaaggaaaatgcg

SEQ ID NO: 1119 - DNA, 409 bp, Zea mays
gggatggcaataaatggggcagacccaacagctggtcatccaagtccctacatgccggcaccttccccttggatgaatcagaggccgctgggtgttgatgtgaatgtcgcttatgtggaaggccgtgaagatcctgacaggggcgtgcagcctcagccactgactcaggattttttgatgatgtcttctgggaaacgcaagagggatgagtatcctggtcagctcccttctggttcttttgtaccacaacaagatggaagtgctgatcagatagtagaatttgttgtgtcaaaggaaaatgcgaatcaactttggagttccatcggcaataagcttgaaacaccaaccaagacaatcactccagttattccgcagcgtgatgggattcaagataactacaatgatcaat

SEQ ID NO: 1120 - DNA, 245 bp, Zea mays
ctgagattgacggcggggcagcgcgcgggcccttcccttcggagcactcagcgtgagagatggggaggcagccgcccaaagacaaggttggcgtgaagaagggcccgtggacggcggaggaggaccagaagctcgtcggcttcctcctcacccacggtcacagctgctggcgcgtcgtccccaagctcgcagggttgctgaggtgcgggaagagctgcaagctgcggtggaccaactaactgagg

SEQ ID NO: 1121 - DNA, 269 bp, Zea mays
tcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgagg

SEQ ID NO: 1122 - DNA, 181 bp, Zea mays
gcacgaggaaattggcagagcaaaagaatttatagtgaaacaactggaagttgagatggggcaatctatggagatgggaaccattcacgctggaaattttctgagacgtttctgctcaactcttgggatgaacaatcaagctgttagggcagcccaggatgcagttaagcactcggaggag

SEQ ID NO: 1123 - DNA, 342 bp, Zea mays
agatgggaacattcatgctggagattttctgaggcgtttctgttcaactcttggaatgaccaatcaagctgttaacgcagccaaggaggcagttcagcgctcagaggagcttgatataaggaggagcccaatctcaattgcagccgccgtcatttacatgataacccaactctcagaggacaagaagccacttaaagatatatccttggctactggtgtggcagaaggcaccatcagaaattcgtacaaggatctgtatccctacgcctcaaggctcatcccgaatacttacgccaaggaagaagacctgaagaatctgtgcacaccttaggaagctttact

SEQ ID NO: 1124 - DNA, 276 bp, Zea mays
  unsure (1)..(276): unsure at all n locations
gcagaaggcaccatcagtagccaaggatatatctttaagtggcttcttgtcctctgagagttgggttatcatgtaaatgacggcggctgcaattgagattgggctcctccttatatcaagctcctctgagcgctgaactgcctccttggctgcgttaacagcttgattggtcattccaagagttgaacagaaacgcctcagaaaatctccagcatgaatgcgtcccatctccatagattgccccatctcaacttccagntgtgtcactataaattc

SEQ ID NO: 1125 - DNA, 433 bp, Zea mays
  unsure (1)..(433): unsure at all n locations
aaagtgaaacaactggaagttgagatggggcaatctatggagatgggaaccattcacgcttcagattttctgagacgtttctgctcaactcttgggatgaacaatcaagctgttagggcagcccaggatgcagttaagcactcggaggagcttgatataaggaggagcccaatctcaattgcagccgctgtcatttatatgataacccaactctcagaggacaagaagccacttaaagatatatccttggctactggtgtggcagaaggcaccatcagaaattcttacaaggatctgtatccttatgcctcaaggctcatcccgaatacctacgccaaggaagaagacctgaagaatctctgcacaccttaggaagcttaccttttccccctttctgttantacataaatcggaattagatttgtcaaagagg

SEQ ID NO: 1126 - DNA, 396 bp, Zea mays
  unsure (1)..(396): unsure at all n locations
ggtgatagtaaatgatcaatggggagacagccggctgtgacaggagggggtgaagcgagggccatggacagcggagaggacaagaagctcattagcttatcctgacacatggccggtgctgctggcggcagtgcctaaactcgcagggctgcttcgttgcggcaagagctgccgtctgcggtggactaactatcttcgccctgacctcaagcgtggcctcctcagcactgccgaggagcagcttgtcattgacctccatgccaagctcggaaatagatggtcccagattgctgccaagttgcctgngagaacagacaacgagatcaagaaccactggaacacgcacatcaagaagaagcttgtcaagatgggtgtcgacccggccacacacgagcc

SEQ ID NO: 1127 - DNA, 380 bp, Zea mays
agatcgatcggtgcttttaatctctgaccaagcgatcgtgctcaccatcaaccaccgcgctcatgagtatcagccggccggacccgagcacgaccaggcggtggcatggggaggccgccgtgctgcgacaaggtgggagtgacgaaagggccgtggacccccgaggaggacttcatgctcgtctcctatgtcgaggagcacggccccgggaactggcgcgccgtgccgacgaacaccgggctgatgcgctgcagcaagagctgcacgttgcggtggacaaactacctccggccgggaatcaagcgcggcaactttaccgaccaggaggagaagctcatcatccacctccaggctctccttggcaaccggtgggcggcgat

SEQ ID NO: 1128 - DNA, 437 bp, Zea mays
atcgatcggtgcttttaatctctgagcaagcgatcgagctcaccaacggccaccgcgctcaagagtagcagccggccggagccgaaaacgacgaggcggtggcatggggaggccgccgtgctgcgacaaggtgggagtgaagaaagggccgtggacccccgaggaggacctcatgctcgtctcctatgtccaggagcacggccccgggaactggcgcgccgtgccgaccaacaccgggctgatgcgctgcagcaagagctgcaggttgcggtggacaaactacctccggccgggaatcaagcgcggcaactttaccgaccaggaggagaagctcatcatccaccttcaggctctccttggcaaccggtgggcggcgatagcgtcctactttgccgagaggacggacaacgatatcaagaactactggaacacgcacc

SEQ ID NO: 1129 - DNA, 315 bp, Zea mays
gccgatgatgatcctggttcttatttcattagtgctgtctgctggaagagtgatagccctacgatgttaactgctaacagtcaggggaccataaaagttcttgtacttgctccttgatgttatggagggcgttcaagaggttcacagtactgtccagttgtttcctttcgtgtcattatcttcccccaaaattggtaacgggggcataattaatttccggttagggaatgaagttttgcagatggtcagctgacgtagggttttgaggtatcagaatgtgcatagtcatgtttatgttgtataggtgtaattgtg

SEQ ID NO: 1130 - DNA, 158 bp, Zea mays
gtccgacgcggccgggtcgggggaggaagcgagcaagaaggtgcggaagccgtacacaatcaccaagtcccgggagagctagacggagcaggagcacgacaagttcctcgaggccctgcagctctttgatcgtgactggaagaagatagaggcttttg

SEQ ID NO: 1131 - DNA, 434 bp, Zea mays
ctccacgcgagcggacgacactaagcggccatagccgcacgttgggatcctctccgctacgcctgtcgatggtctccgccagcgcgccgccgtcgcaggcccagtccgacgcggccggctcggcggaggaagtgagcaagaaggtgcggaagccgtacacaatcaccaagtaccggaagagctggacggatcaggagcacgacaagttgctcgaggccctgcagctctttgatcgtgactggaagaagatcgaggctgtcgatggctccaagactgtcatgcagattcatcttacatccataggaactctggcatgaacgtgcctgtttgttcatgggctcatagttacatcccacaagctgatgcttcatcaatggtgaaagatttatgtgctggaacaccaggttcaaacaatttctgctcaagtagtactg

SEQ ID NO: 1132 - DNA, 304 bp, Zea mays
gctggagatgatgataatgatgatgatgatgatgaacctcctcttaatgaagacgacgacgaggagttagatgaccttgagcaaggggaggatgaacctaacacacaacatcttgtacttgcacaatttgataaagtgtcaaggaccaagaatcgttggaagtgcaccttgaaggatggaatcatgcatttgaatggcagggatgtcctttttaacaaggcgacaggtgagtttgatttttgattttttggatgaagatgagctattttagaagcagctgtatggacatatctttgtcttgaca

SEQ ID NO: 1133 - DNA, 407 bp, Zea mays
cgcagcgtgatgggtttcaaggatactccaaggttcaatttttctttccaggagttcggaccgaagattataatacccctggagaatctgcggagtatcgagctcctacacctgctgttggaacaccaaaacaaagaaatgatgctggagatgatgataatgatgatgatgatgatgaacctcctcttaatgaagacgacgacgaggagttagatgaccttgagcaaggggaggatgaacctaacacacaacatcttgtacttgcacaatttgataaagtgtcaaggaccaagaatcgttggaagtgcaccttgaaggatggaatcatgcatttgaatggcacggatgtcctttttaacaaggcgacaggtgagtttgatttttgattttttggatgaagatgagct

SEQ ID NO: 1134 - DNA, 464 bp, Zea mays
aaggtgtctcactggcggctcagtgacctagactcgcgggtcgacgcaagcctctacagtgagcccgatcagcatcgaaccagcacatcgcaagacaagcagcagcagccaccactgccatcacatggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgatgccgccgcgcgcgcgcacgacgtggccgcgctggccctgcggggccgcgccccgtgcctca

SEQ ID NO: 1135 - DNA, 418 bp, Zea mays
gccacttaaagatatatccttggctactggtgtagcagaaggcaccatcagaaattcgtagagggatctgtatccttatgcctcaaggctcatcccgaatacctacgccaaggaagaagacctgaagaatctctgcacaccttaggaggcttacttttttccccctttctgttactacataattcggaattagatttgtcaaagaggagtgagtgaagttgttcctcgttgtgactgtaccgggcaaggtgtcgtccccgccgtgcttaactttatgatggaatttcttttcagagcacctaccacctgaagatttgtgggatacgtatactcacttcggaaagaatgtagatagcaagcagttggacaagcacaagattttaatttaaaacatgattttgttctccatcttctgaag

SEQ ID NO: 1136 - DNA, 266 bp, Zea mays
ggatctgccagattccacaaggtcttgcaaggtcaagaattgttgggtttcaaaacccatgatggtcctgctatttctgcttctcaggcaactgaagcaagaaatttgcagtacagtgatgaacggagtaacaataacttaggatcccaagacttggtgttaggtctccaactggaatccctgggtttccctaccattgctcaggctttggggaatctcaaagattccaaaaggtcttgcaaggtcaagaagtgtttcatcctttc

SEQ ID NO: 1137 - DNA, 329 bp, Zea mays
ataaagatgcgatggcagaatcatattgtactgcaagagtgacaattgtgtgttccagtcacatatatgacctagttttgtgtgtctatatgtcgaaacccatatgtctgtgattttattatatgttatgtaagcacaaatgaaacatgccggactagttgcttttgcttgtctatgtatttgtttattccctttgcctcaaagatccatcttcagggtagccatgccggcatgaagttattcatatgctcgggagcgaacccgatctgcagggttggctctgctgcagcttccaggggatgaaagaataatccctagttctagatcgc

SEQ ID NO: 1138 - DNA, 439 bp, Zea mays
cccacgcgtccgcttcatgccggcatggctactcctgaagatggatctttgaggcaaagggggtaaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgtaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaataatataaaaaaaaaaaaaaaaataaaaaaaataaaaaaaaggggcgccctttttaaggagccaaattttacgtacccttacttgcaacgcaatagttttt

SEQ ID NO: 1139 - DNA, 450 bp, Zea mays
aaggaatctttcagctcacacctccctatccctccttcccttctcctcctactgctactgctcgccaggtcccctcgctcgctcgctcgtcgtcttcaacctcacacaattatttgtgctcccgctccttccgtccgtccttcctccccccttcccctctccctcttccaaccgccgctcctgctgccttgcctctcagcccagggacgccaaggtctctgccaggatggtgtaggccgtgcctctcgcgcattatgaggtgtggtggtgagggatgggcgatggcctttgcagatgaaggagcgacagcgctggcggcctgaggaagacgccgtcctgcgcgcctacgtccggcagtacggcccccgcgagtggcacctggtgtcgcagcgcatgaacgtggccctcgaccgcgacgccaagtcgtgcctggagcgcttgaagaactac

SEQ ID NO: 1140 - DNA, 282 bp, Zea mays
gcagaatcgctgagggatcgtcgatccggagaggcaaaaaagccgagagatcaggcagggcaccatggggcgcgggaaggtggtgctgcagcggatcgagaacaagatcagccggcaggtgaccttcgccaagcgccggaaggcctgctcaagaaggcgtacgagctctccatcctctgcgacgccgaggtcgcgctcgtcctcttctcccacgccggccgcctctaccagttctcatcctcctccaatctgcttaagactctagagcggtaccagaggtac

SEQ ID NO: 1141 - DNA, 416 bp, Zea mays
  unsure (1)..(416): unsure at all n locations
cgttatcgctatgnttttcatgggggtcgatttctctcgaatatccgtccgacccactcgtccgatggcgcctgtgtgtcagagagatttgcacttaatcgtgaggatcagtgatgcgaggggcaacaagtcgagagatcaggcagggcaccatggggcgcgggaaggtggtgctgcagcggatcgagaacaagatcagccggcaggtgaccttcgccaagcgccggaacggcctgctcaagaaggcgtacgagctctccgtcctctgcgacgccgaggtcgcgctcgtcctcttctcccacgccggccgtctctaccagttctcatcctcctccaatctgcttaagactctagagcggtaccagaggtacatctatgcttcagtcgatgctgcagtgccatctagcgatcagatg

SEQ ID NO: 1142 - DNA, 325 bp, Zea mays
  unsure (1)..(325): unsure at all n locations
cccacgcgtccgcccacgcgtccgtttgaatgcagcagaatcgctgagggatcgtcgatccggagaggcaaacaagtcgagagatcaggcagggcaccatggggcgcgggaaggtggtgctgcagcggatcgagaacaagatcagccggcaggtgaccttcgccaagcgccggaacggcctgctcaagaaggcgtacgagctctccgtcctctgcgacgccgaggtcgcgctcgtcctcttctcccacgccggccgnctctaccaggtctcatcctcctacaatctgcttaagactctaaagcggtaccagaggtacatctatgc

SEQ ID NO: 1143 - DNA, 271 bp, Zea mays
caaggatgatagtggatctcctactgatgactcaggtgatgaggaatcagatgctagtgatagtggtggtgaaaaggagaaatcatccaagaaggaagcaagcagttcaaagccagttcagaaaagaaagcataaggccagggatgacgaaggacaagagaagaaaaagccaaagaagaaaaaagatccgaatgctccgaaacgaagcatgaccccgttcatgtaattctcaatggctgagcgagggaacatgaagagcaagaacccagat

SEQ ID NO: 1144 - DNA, 410 bp, Zea mays
agaggatgaagatttcgttgcagacaaggatgatagtggatctcctactgatgactcaggtgatgaggaatcagatgctagtgatagtggtggtgaaaaggagaaatcatccaagaaggaagcaagcagttcaaagccagttcagaaaagaaagcataagggcagggatgacgaaggacaagagaagaaaaaaccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaaacgttatgaaaaag

SEQ ID NO: 1145 - DNA, 258 bp, Zea mays
gcagttcctttccggcctggagaagctgggcaagggcgactggcgaggcatctccaggagctacgtgccgacgaggaccccgacgcaggtcgccagccatgcacagaagttcttcctcaggcagagcagcttggggaagaagaagcgccgctccagcctctttgacatggtgccgatttgcgagaacagtgcgagcatctccgatccgctgggcagcgaaggggcctcaacctctctgtcgctgaacgtgccacgcca

SEQ ID NO: 1146 - DNA, 438 bp, Zea mays
gttccatggagcgaggaggagcacaggcagttcctttccggcctggagaagctgggcaggggcgactggcgaggcatctccaggagctacgtgccgacgaggaccccgacgcaggtcgccagccatgcacagaagttcttcctcaggcagagcagcttggggaagaagaagcgccgctccagcctctttgacatggtgccgatttgcgagaacagtgcgagcatctccgatccgctgagcagcgaaggggcctcaacctctctgtcgctgaacgtgccacgccacggcgtcacctccgtctccgagagggcggccttggacctgaattcgacggaggaagacgacagcagggcggacgcgtcgtcggcatcggcatcaggtgcagggaccagaccaccgttcccggcagcgcagacggagccgctgcagccttcgtcg

SEQ ID NO: 1147 - DNA, 597 bp, Zea mays
  unsure (1)..(597): unsure at all n locations
gggncgccannaagcgttagctccggcaggcctcggaattccggaatcgaccacgcgtcgggcattgcgagcgagcgttactctccgtccgcttccgccgtttgcccgtcgatcagttgttggctgccggccgggtactaccgcctgcacgagcagcggctagccacagcccacagacagacgacgtcaggtcttggcaggtgtgcaagcagacagagctcgctcggtcgccatgtctttcaccggcacgcaggacaagtgcaaagcctgcgacaagacggtccacttcatcgacctgctcaccgccgacggcatctcgtaccacaagacctgcttcaaatgcagccactgcaagggcgtcctctcgattagcagctactcttccatggacggcgttctgtactgcaagacgcacttcgaacagctcttcaaggagacagggaacttctccaagaaattccaaggtggaggtggagcatcttcaaacaagaacgacccggcaaaggctccgagcaagctgtcatctgcattctctggaactcaagacaaatgcgcagcctgccagaagaccgtgtatccattggagaagatgacgct

SEQ ID NO: 1148 - DNA, 370 bp, Zea mays
agatccgcgccgccgcaagagaggaggagagaccacctccaacgccacccggaaaaaggacagcgcggcggggaggaggaagaagaagaacatggggaagggcgtcctggaggtgcacctcgtcgacgccaagggcctctccggcaacgatttcttagggaagctggacccctacgtgatcatgcagtaccggagccaggagcgcaagagcagcgtcgcccgagaccaaggaaggaacccgtgctggaacgaggtgttcaagttccagatcaactcggccgcggccaacgtgcagcacaagctcatcctacggatcatggaccacgacaacttctccagcgacgacttcctcggcgaggcgacgatcgac

SEQ ID NO: 1149 - DNA, 470 bp, Zea mays
gcagcagctggagagttcactgaaacatatcagaacaaggaagagccagcttatggtcgagtgaagttcagcgctccaacggaaggagaagtcactgcaggaggagaacaaggttctgcagaaggagctcgcggagaagcagaaagaccagcggcagcaagtgcaacgggaccgaactcaacagcagaccagttcgtcttccacgtccttcatgttaagggaagctgccccaacaacaaatgtcagcatcttccctgtggcagcaggcggcagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcag

SEQ ID NO: 1150 - DNA, 457 bp, Zea mays
gagccagcttatggtcgagtcaatttcagcgctccaacggaaggagaagtcactgcaggaggagaacaaggttctgcagaaggagaaagcgttactcctgcatgcagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaagtttgccctcaccgtcgcgatgtgatagcccaaaatccagcaagtcttccccggaccccggactgtccccgcttctccgtctggtgcagtatcgtcgtgatcgcgagaagcagcagcagcggt

SEQ ID NO: 1151 - DNA, 382 bp, Zea mays
agcagcagctggagagttcactgaaacattttacaacaaggaagagccagcttatgggcgaggcaatttcagcgctccaacggaaggagaagtcactgcaggaggagaacaaggttctgcagaaggagctcgcggagaagcagaaagaccagcggcagcaagtgcaacgggaccgaactcaacagcagaccagttcgtcttccacgtccttcatgttaagggaagctgccccaacaacaaatgtcagcatcttccctgtggcagcaagcgggacggtggtggaaggggcagcagcgcatccgcaggctcgcgttggactgccaccatggatgcgtagccatctgagctgctgaagcttgccctcaccgtcgcgatgtgatag

SEQ ID NO: 1152 - DNA, 382 bp, Zea mays
  unsure (1)..(382): unsure at all n locations
ggccgccatcgcgcgccttctcccggggcgcaccgacaacgccgttaagaaccactagaactcgtggctcaagcggaagctcgccaccgccacggcgacctccagcggcagcgatgctgagcgggcgtgcaagcgcgcaagccctggcccggggagcccgacggcgtcggaccgcagcgacctcagccacggctgcggcgccgcgcaggtgttccgtcccgtcccgcgcgccggaggcttcgacgccatcagcgccgcagacgtgcgccctccgcccccgccagcagtcgcagacgaggacccgctcacctcgctctccctctcgctgccggtgctggaccagtcgccgtcgggcttncaccacgacagcgcccggagccac

SEQ ID NO: 1153 - DNA, 286 bp, Zea mays
ggacggtcgagccggagaggaaaagctagctagcagctaccagctctcggccggcggtggtagtctgcctgcagctggggttagttagctgcaagggttgggagccatggggaggggtcgggtggagctcaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcgga

SEQ ID NO: 1154 - DNA, 404 bp, Zea mays
cctgagtcctgcctgcgctcgcctcctttcttcccccccggccccttggcttttgcttgggggcgatcgggccggtcgagccggagaggccggaaaagctagctagctaccagctctccggtgtggtagtacgtctgcctgcagctggggttagctgcaagggttgggagccatggggaggggtcgggtggagctcaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggaaagctcttacaagttctgcagcggacagagcataaccaaaccactggaaaggtttgaaaaaaccagttttggagga

SEQ ID NO: 1155 - DNA, 448 bp, Zea mays
catctcctgagtcctgcctgcgctcgcctcagctcctttcttccccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaactgtgctg

SEQ ID NO: 1156 - DNA, 427 bp, Zea mays
cccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaaccaggagaacgagttagtccagagcagtcgtaatgagta

SEQ ID NO: 1157 - DNA, 515 bp, Zea mays
  unsure (1)..(515): unsure at all n locations
tgagtgtctgcccagtccgacgatgcactcncactccttgttttaccgggccgaccgacgcgtccgcccacgcgtccgcccacgcgtccggcctgtgctcgcctcagctcctttcttccccgcccgttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaatacagttatggaggaccagatactgctgtacagaacatggagaa

SEQ ID NO: 1158 - DNA, 301 bp, Zea mays
ctcttctccagcgtccgacttcccactcgcctccctcaccgcagctctcccggctcggtcccttcccacctcctccctccccccgcacgcgctcgccacctcgccctcccctccacgttgctcgcacccgcgcttatataagcgcacgaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggcca

SEQ ID NO: 1159 - DNA, 289 bp, Zea mays
cgcaacctcccgggccgccttctcttctccagcgtccgatctcccactcgcctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagcacgagagcgggagcccaggggaggcggagcggtggcacgtcagggacaggacaggttctgccatcgcaacatcatcggtcatgaag

SEQ ID NO: 1160 - DNA, 438 bp, Zea mays
cccacgcgtccgcggacgcgtgggtcgcaccctcccgggccgccttctcttctccagcgtccgatctcccactcccctccctcaccgcagctctcccacctacgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaa

SEQ ID NO: 1161 - DNA, 301 bp, Zea mays
tgcttggtaccatcgggccggagagggagaagctagctagctagcagcagctctgttggtgtgtgtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcg

SEQ ID NO: 1162 - DNA, 421 bp, Zea mays
ggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcatgcccagatactgctgtacagaacatagagaacgagttagtccagaacagccgcaatgagtaccttaaactgaaagcaaaggtggataatttacagaggactcaaaggaatttgcttggtgaaaatctgggttcacttggggtcaaagagcttg

SEQ ID NO: 1163 - DNA, 456 bp, Zea mays
cccacgcgtccggcctgcagctggggttagctgcaagggttgggagccatggggaggggtcgggtggagctcaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcatcaccaaaacacttgagaggtatgaaaaaaacagttatggaggaccagatactgctgtacagaacaaggagaacgagttagtccagagcagtcgtaatgagtacctcaagctgaaagcgaaggtggataatttacagaggactcagaggaatttgcttggtgaagatctggggtcacttggtgtcaaagagcttgagcagcttgagaagcaacttgattca

SEQ ID NO: 1164 - DNA, 448 bp, Zea mays
cccacgcgtccggcctgcagctggggttagctgcaagggttgggagccatggggaggggtcgggtggagctcaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcatcaccaaaacacttgagaggtatgaaaaaaacagttatggaggaccagatactgctgtacagaacaaggagaacgagttagtccagagcagtcgtaatgagtacctcaagctgaaagcgaaggtggataatttacagaggactcagaggaatttgcttggtgaagatctggggtcacttggtgtcaaagagcttgagcagcttgagaagcaac

SEQ ID NO: 1165 - DNA, 433 bp, Zea mays
cccacgcgtccggctctcctcctttttctccactccgcttttgcttggttccatcgggccggagagggagaagctagctagctagcagcagctctgttggtgtgtgtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgaaaggtacgaaaaaaacagttatgcaagcccagatactgctgtacagaacatagagaacgagttagt

SEQ ID NO: 1166 - DNA, 373 bp, Zea mays
ctcctcctttttctccactccgcttttgcttggttccatcgggccggagagggagaagctagctagctagcagcagctctgttggtgtgtgtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagtta

SEQ ID NO: 1167 - DNA, 258 bp, Zea mays
gatacttctgctgttgcggagagttctgcagcttcagctcttatgcccgagagtttacagcctacctatccgatgattgttccagcttatttctcaccgttcttgcaattctcagttcctttctggccaaatcaggaagatggaggtgatctgcctcaagaaacgcacgagattgtcaagcctgttgcagttcattccaagaatccaattaatgttgatgaacttgtgagcatgtcaaagctaagcataggggagcct

SEQ ID NO: 1168 - DNA, 249 bp, Zea mays
cctttctggccaaatcaggaagatggaggtgatctgcctcaagaaacgcacgagattgtcaagcctgttgcagttcattccaagaatccaattaatgttgatgaacttgtgagcatgtcaaagctaagcataggggagcctggtcaggaaacggtgtctacttctctgtcgttaaatctgctggtgggtcaaaataggcagtcggccttccatgcaaatcctcaaacgagggctcaagcttgatcccgc

SEQ ID NO: 1169 - DNA, 284 bp, Zea mays
aacacacgagattgtcaagcctgttgcagttcattcccagaatccaattaatgttgatgaactcgtgggcatgtcaaagctaagcatatgggagcatggtcaggagacagtgtctacttctctgtcgctaaatctgctagggggtcaaaataggcagtcggctttccatgcaaaccctcaaacaagagctcaagcctgatcatcccctaccagcacagaaactgtattttagatggaatcctgggcaaaataagctttgctctttttttcttcttctaaattta

SEQ ID NO: 1170 - DNA, 421 bp, Zea mays
ggccaaatcaggaagatggaggcgatcttccccaagaaacacacgagattgtcaagcctgttgcagttcattcccagaatccaattaatgttgatgaactcgtgggcatgtcaaagctaagcatatgggagcatggtcaggagacagtgtctacttctctgtcgctaaatctgctagggggtcaaaataggcagtcggctttccatgcaaaccctcaaacaagagctcaagcctgatcatcccctaccagcacagaaactgcattttagatggaatcctgggcaaaataagctttgctctttttttcttcttctaaatttaagatcactgagtcataaggtcactggttcgaagtagcttctccgtatttgcggggaaagcctgccctgggttctctccttcatcagaccccactcatatg

SEQ ID NO: 1171 - DNA, 414 bp, Zea mays
agatacttctgctgttgcggagagttctgcagcttcagctcttatgcccgagagtttacagcctacctatccgatgattgttccagcttatttctcaccgttcttgcaattctcagttcctttctggccaaatcaggaagatggaggtgatctgcctcaagaaacgcacgagattgtcaagcctgttgcagttcattccaagaatccaattaatgttgatgaacttgtgagcatgtcaaagctaagcataggggagcctggtcaggaaacggtgtctacttctctgtcgttaaatctgctggtgggtcaaaataggcagtcggccttccatgcaaatcctcaaacgagggctcaagcttgatcccgcttccgcacagaaactgcattaagaaggattccctctctttttttttt

SEQ ID NO: 1172 - DNA, 296 bp, Zea mays
  unsure (1)..(296): unsure at all n locations
tcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccanagtgcaagcttccatcgcggcaaacacatgggtggtcagtggatctccacagacgataaagctaca

SEQ ID NO: 1173 - DNA, 310 bp, Zea mays
tgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgatgaggtgaacgtattcaaggacgatgtcgtcatccagttcttgaaccccaaagtgcaagcttccatcgcagcaaacacatgggtggtcagtggatctcc

SEQ ID NO: 1174 - DNA, 309 bp, Zea mays
ccgacccatcactctctgctcgcgcactctcacctgcccgcgccgtattcgaccgccgccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcggcaaacacatgg

SEQ ID NO: 1175 - DNA, 309 bp, Zea mays
ctccgacccatcactctctgctcgcgcactctcacctgcccgcgccgtattcgaccgccgccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcggcaaacacat

SEQ ID NO: 1176 - DNA, 268 bp, Zea mays
ccgacccatcactctctgctcgcgcactctcacctgcccgcgccgtattcgaccgccgccaagatgaacaaggagatgctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggatgtgaacatattcaaggacgatctcgtcatccagttct

SEQ ID NO: 1177 - DNA, 227 bp, Zea mays
cccacgcgtccgccgacgcatcactctctgctcgcgcactctcacctgcccgcgccgtattcgaccgccgccaagatgaacaaggagatgctcatgaagatggccggcgccgtccgcaccggcggcaagggcaccatgcgcaggaagaagaaggctgtacacaagacggtcaccacggacgacgagaggctgcagggcactctcaagagagtaggagtcaacaccat

SEQ ID NO: 1178 - DNA, 361 bp, Zea mays
cgcactctcagctgctcgcgccgtcttcgaccgccaccaagatgaacaaagagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccatgcaatcgaggaggtgaacatattcaaggacgatctcgtcatccagttcttgaaccccatagtgcaagcttccatcgcagcaaacacatgggtggtcagtggatctccacagacgagaaagtacaggatgttctccctgggatcattaagcagcttggcgctgac

SEQ ID NO: 1179 - DNA, 434 bp, Zea mays
  unsure (1)..(434): unsure at all n locations
aggcccgcnccgtattcnaccgccgccannaattaacaaggagaggctcatgaagatggccggcgccgtccgcaccggcngcaagggcaccatgcncaggaagaataacgctgtacacaanacggtcaccactgacgacaanatgctgcagggcactctcaagagagtacgggtcaacaccatccctgcaatcnangaggtnaacatattcaaggacgatctcgtcatccagttcttgaaccccaaagtgcaagcttccatctcggcaaacacatggntggtcantggatctccacanacgaaaaagctacaggatgttctccctggtatcattaaccancttggcctgacaacatggagcacctgaagatgattgcccaagganatcncaagcaggtggctgccnccggttcgcancacaggtcaaggaaaaa

SEQ ID NO: 1180 - DNA, 422 bp, Zea mays
cccacgcgtccgcctccccaaaggccctaacctatcgcccgtacgagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggat

SEQ ID NO: 1181 - DNA, 435 bp, Zea mays
cggacgcgtgggcgaccgccaccaagatgaacaaggagaggctcatgaagatggccggggccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggatgttctccctgggatcattaaccagcttggccctgacaacatggagcacctgaagaggattgccgaggagatgcagaagcaggtggctgctgccggtgcggcagcacaggtcaaggaagacaacg

SEQ ID NO: 1182 - DNA, 461 bp, Zea mays
  unsure (1)..(461): unsure at all n locations
agtgttggaggtacgtcactagacangcacggtctagatatccgggccgagccacgcgtccacccaagcgtccggacccatcactctctgctcgcgcactctcacctgcccgcgccgtattcgaccgccgccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcggcaaacacatgggtggtcagtggatctccacagacgaaaaagctacaggatgttctccctggtatcatttaacagcttggccctgacaacat

SEQ ID NO: 1183 - DNA, 379 bp, Zea mays
gctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttccgtttagcgctgcttttgtccgtatatttaggatgatttgacttgtgctacttttgggcaccttttacatttacagatatgtattattcagcataaatataatatagtagtc

SEQ ID NO: 1184 - DNA, 283 bp, Zea mays
tgtgcttactacatattctatagtaagcatggaagtaccaaaacaatcaaatcctgatagtgatggagaagagaaagggaagcctgacacgtatggtgcacctgtgtcctcttcagggagcaaaaagagaaaggcatcctcttctaagaaaacaaaaaataaaagtgttgcagagagttgcttgcctgaaaaacctcttgcgaaagttgcttggtttagggttattcttgatgaagcacaaagcattaagaactaccgaactcaggttgccagggcttgctgg

SEQ ID NO: 1185 - DNA, 267 bp, Zea mays
agacgctgcagttcgagcacaagctgttctactttgatctgaaggagaacccgcgggggaggtacctcaagatctccgagaagacatcggccacgcgctccaccatcatcgtccccatcgacggcgtcgcctggttcctcgacctcttcgactactacatccgcaccgacgagcgcgacgtcttcagcaaggagctgcgactccagaccaaggtgttctatttcgatatcggggagaacaagaggggccgattcctcaaggtttctg

SEQ ID NO: 1186 - DNA, 273 bp, Zea mays
agacgctgcagttcgagcacaagctgttctactttgatctgaaggagaacccgcgggggaggtacctcaagatctccgagaagacatcggccacgcgctccaccatcatcgtccccatcgacggcgtcgcctggttcctcgacctcttcgactactacatccgcaccgacgagcgcgacgtcttcagcaaggagctgcgactccagaccaaggtgttctatttcgatatcggggagaacaagaggggccgattcctcaaggtttctgaggcct

SEQ ID NO: 1187 - DNA, 257 bp, Zea mays
cccacgcgtccggcctgacgaaggaaattctcaagcgttccaaaggatcctgaccactagacagtcagctcgggcgctacttgtgataagtgattactcttcacgtctccgtgccctaagctctctctggcttgctcggcccaaggaatagcaagaacatgctatttgactgcaatacttttcacaatttggttttcaatggtcaggagatttgacaaggctgcgacagacttgattcggacatatctgcacatact

SEQ ID NO: 1188 - DNA, 308 bp, Zea mays
cccacgcgtccgatataattcacctaataatttgtgttgtttgtttgtcttttaacttatttaagctggattatataatctagagggtaaacaaacagggcaagtattacatgtgattctattagtcattgaacacatttttacagatagacagtgaattaagcaaagagatagaacaatggaatgacatgctgaggactgaagtagtaaagttgtgtcaagacaacaattttcaaacaggttttattgaaggcactgataatagcactgttgttgatgcttacgagttgaaggtaaatctaaatgta

SEQ ID NO: 1189 - DNA, 272 bp, Zea mays
ctcattttagtggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctacgtcctgaaaacttgaggcctgatgcattattctctgggaacacagctgatccatccattttcaataatgccatagccatgctcctgggcaatggcattgatgccgagtacaa

SEQ ID NO: 1190 - DNA, 421 bp, Zea mays
gtcaggaatattgggaagaacagcccagttctttcctcagtgaatatgctcattgtgggggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgggcaatggcattgatgccgagtacaaacctgttcttggtgatggaattgtgctcgattcttcgtcatggaacaacatgcaacatgcttttcagatggcgggattcaaatgagttccatgcaccttgtt

SEQ ID NO: 1191 - DNA, 88 bp, Zea mays
ggtaaacccgctagctgtgtaatcttgtttagctatcatgtatgcttgttactgcccagttacccttgaatctagcggcgcttttggt

SEQ ID NO: 1192 - DNA, 100 bp, Zea mays
cgggtaaacccgctagctgtgtaatcttgtccatctatcatgtatgcttgttactgcccagttgcgcttgaatctagcggcgcttttggtgagagggtgc

SEQ ID NO: 1193 - DNA, 300 bp, Zea mays
gacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcaagaagcagccgccgccgccgccgcctat

SEQ ID NO: 1194 - DNA, 396 bp, Zea mays
ccgaggtcgcgctcgtcgtcttctccccgctcggcaagctctatgaattcgccagcggaagtgcccagaaaacaattgaacgttatagaacgtacacaaaggataatgtcagcaacaagacagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcatgaagc

SEQ ID NO: 1195 - DNA, 429 bp, Zea mays
  unsure (1)..(429): unsure at all n locations
agaacatacacaaaggattatgtcagcaacttgacagtgcagcaggatattgagcgagtggaagctgatgcggatggcctgtcaaagagactcgaagcacttgaagcttacaaaaggaaacttttgggtgagaggttggaagactgctccattgaagagctgcatagtttggaagtcaagcttgagaagagcctgcattgcatcaggggaagaaagactcagctgctggaggagcaagtccgtaagctgaagcagaaggagatgagtctgcgcaagagcaacgaagatttgcgtgaaaagtgcaagaagcagccgcctatgacgatggctccgccgncgactcgtgcgccggcagtcgacaccgtggaggacgatcaccgggagccgaaagacgacggaatggacgtggagacggagctgtacatagga

SEQ ID NO: 1196 - DNA, 272 bp, Zea mays
ggagatcagcgtgctctgcgacgccgaggtcggagtgtcgtcttctccagcgccggcaagctttacgactactgctccccgaagacatcgctatcaaaaatcctggagaaactaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatga

SEQ ID NO: 1197 - DNA, 348 bp, Zea mays
cccacgcgtccgcccacgcgtccggggagatcagcgtgctctgcgacgccgaggtcggcgtcggcgtcttctccagcgccggcaagctttacgactactgctccccgaagacatcgctatcaaaaatcctagagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgatgaggcacttgataatggactgacgaacctgaatgagaaactgatgg

SEQ ID NO: 1198 - DNA, 267 bp, Zea mays
tgtgaagttcagcgtactatgcttgaacttctaaaccagctcgatggttttgaagcatcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctgaaaaagatcgcggaaaagatgaatggggcctca

SEQ ID NO: 1199 - DNA, 300 bp, Zea mays
gtcatggggaaatcaaaggatctggtgaaggtacacccgaagcaaatatgttgttgatatagataagagcattgatatcacaaagatcacaccttcaacaagagtcgctcttcgtaatgatagctatatgctccatctgatcctaccaagcaaagttgatccattggtcaatctcatgaaagttgagaaggttcctgattctacatatgatatgattggaggccttgaccagcaaattaaagagatcaaagaggtcattgagcttccaatcaaacatccggaactatttgagagccttgg

SEQ ID NO: 1200 - DNA, 242 bp, Zea mays
cccgaaggcaaatatgtggtggatatagataagagcattgatatcactaagatcacaccttcaacaagagttgctcttcggaatgacagttatatgctccatctgatcctaccaagcaaagttgatccattggtcaatctcatgaaagttgagaaggttccggattctacctatgatatgattggacggcttgaccagcaaattaaagagatcaaagaggtcattgagcttccaatcaaaca

SEQ ID NO: 1201 - DNA, 231 bp, Zea mays
ccttgaccagcaaattaaagagatcaaagaggtcattgagcttccaatcaaacatccggaactatttgagagccttggaattgcccaaccaaagggtgtcctcctttatggacctccaggcacaggaaagacattgctggcacgtgcggttgctcatcacactgactgtaccttcatcagggtgtctggttctgaattggttcagaagtatattggtgaaggttcccggat

SEQ ID NO: 1202 - DNA, 143 bp, Zea mays
cagggaacatgcaccatccattatatttatggatgaaattgactctatcggatctgctagaatggagtctggaactggcaacggtgacagtgaagttcagcgtactatgcttgaacctctaaaccagcttgatggttttgaag

SEQ ID NO: 1203 - DNA, 229 bp, Zea mays
aatcaaacatccggaactatttgagagccttggaattgcccaaccaaagggtgtcctcctttatggacctccaggcacaggaaagacattgctggcacgtgcggttgctcatcacactgactgcaccttcatcagggtgtctggttctgaattggttcagaagtatattggtgaaggttcccggatggttcgggaactctttgttatggccagggaacatgcgccatcc

SEQ ID NO: 1204 - DNA, 143 bp, Zea mays
cacaccttcaacaagagttgctcttcggaatgacagttatatgctccatctgatcctaccaagcaaagttgatccattactcaatctcatgaaagttgagaaggttccggattctacctatgatatgattggaggccttgacc

SEQ ID NO: 1205 - DNA, 140 bp, Zea mays
ccaaatcctaacgaggattcacgtttcgatatcttgaagatccattcaagaaaaatgaacttgatgcgtggcattgatctgaaaaagatcgcggaaaagatgaatggagcctcaggagctgagctcaaggccgtctgcac

SEQ ID NO: 1206 - DNA, 281 bp, Zea mays
cattgatatcactaagatcacaccttcaacaagagttgctcttcggaatgacagttatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcacaaccaaagggtgtccttcttaatggacctccgggcacaggaa

SEQ ID NO: 1207 - DNA, 180 bp, Zea mays
catcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctga

SEQ ID NO: 1208 - DNA, 275 bp, Zea mays
ctcaagcccttttgaggcctggccgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtatgtacagaggctggaatgtttgctctccgtgagagaagggtgcacgttacccaggaggacttcgagatggcagtggccaaggtgatgccgccc

SEQ ID NO: 1209 - DNA, 270 bp, Zea mays
cccgaagcaaatatgttgttgatatagataagagcattgatatcacaaagatcacaccttcaacaagagtcgctcttcgtaatgatagctatatgctccatctgatcctaccaagcaaagttgatccattggtcaatctcatgaaagttgagaaggttcctgattctacatatgatatgattggaggccttgaccagcaaattaaagagatcaaagaggtcattgagcttccaatcaaacatccggaactatttgagagccttggaattg

SEQ ID NO: 1210 - DNA, 265 bp, Zea mays
cccgaaggcaaatatgttgttgatatagataagagcattgatatcacgaggatcacaccttcaacaagagtcgctcttcgtaatgatagctatatgctccatctgatcctaccaagcaaagttgatccattggtcaatctcatgaaagttgagaaggttcctgattctacatatgatatgatgggaggccttgaccagcaaattaaagagatcaaagaggtcattgagcttccaatcaaacatccggaactatttgagagccttg

SEQ ID NO: 1211 - DNA, 275 bp, Zea mays
acattttggatcaagcccttttgaggcctggccgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtctgtacagaggctggaatgtttgctctccgtgagagaagggtgcacgttacacaggaggacttcgagatggcagtggccaaggtg

SEQ ID NO: 1212 - DNA, 260 bp, Zea mays
acattttggatcaagcccttttgaggcctggccgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtctgtacagaggctggaatgtttgctctccgtgagagaagggtgcacgttacacaggaggacttcgagatg

SEQ ID NO: 1213 - DNA, 259 bp, Zea mays
acattttggatcaagcccttttgatgcctggccgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtctgtacagaggctggaatgtttgctctccgtgagagaagggtgcacgttacacaggaggacttcgagat

SEQ ID NO: 1214 - DNA, 197 bp, Zea mays
attggtcaatctcatgaaagttgagaaggttccggattctacctatgatatgattggaggccttgaccagcaaattaaagagatcacagaggtcattgagcttccaatcaaacatccggaactgtttgagagccttggaattgcgcaaccaaagggtgtccttctttatggacctccgggcacccgaaagacattgt

SEQ ID NO: 1215 - DNA, 290 bp, Zea mays
ccagcttgatggttttgaagcttcaaacaaaattaaggttttgatggcaacaaacagaatagacattttggatcaagcccttttgaggcctggccgcatagacaggaagattgagtttccaaatcctaacgaggactcacgtttcgatattctgaagatccattcaaggaaaatgaacttgatgcgtggtatcgatctgaaaaagatcgcagagtagatgaatggggcctcaggagctgagctcaaggccgtctgtacagaggctggaatgtttgctctccgtgagagaa

SEQ ID NO: 1216 - DNA, 261 bp, Zea mays
ccagcttgatggttttgaagcttcaaacaaaattaaggttttgatggcaacaaacagaatagacattttggatcaagcccttttgaggcctggccgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtctgtacaga

SEQ ID NO: 1217 - DNA, 262 bp, Zea mays
atgttccggattctacctatgatatgattggaggccttgaccagcaaattaaagagatcaaagaggtcattgagcttccaatcaaacatccggaactgtttgagagccttggaattgacaaccaaagggtgtccttctttatggacctccgggcacaggaaagacattgttggcacgtgcggttgctcatcacactgactgcaccttcatcagggtgtctggttctgagttggttcagaagtatattggtgagggctcccgg

SEQ ID NO: 1218 - DNA, 275 bp, Zea mays
agcgtactatgcttgaacttctaaaccagctcgatggttttgaagcatcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctgaaaaagatcgcggaaaagatgaatggggcctcaggagctagctcaaggccg

SEQ ID NO: 1219 - DNA, 214 bp, Zea mays
caggcctcagaagggcttgaatttccaaatcctaacgaggattcacgtttcgatatcttgaagtctattcaagacaaatgaacttgatgcgtggcattgatctgaaaaagatcgcggaaaagatgaatggggcctcaggagctgagctcaaggccgtctgcacagaggctggaatgtttgctcttcgtgagagaagggtgcacgttacccagga

SEQ ID NO: 1220 - DNA, 266 bp, Zea mays
atgttagagccttggaattgcccaaccaaagggtgtcctcctttatggagctccaggcacaggatagacattgctggcacgtgcggatggttcgggaactctttgttatggccagggaacatgcgccatgcatgatatttatggatgaaattgactctatcggatctgctagaatggagtctggaactggcaacggtgatagtgaagtgcagcgtaccatgcttgcacttctaaaccagcttgatggttttgaagcttcaaacaaa

SEQ ID NO: 1221 - DNA, 179 bp, Zea mays
gaatgttccggattctacctatgatatgattggaggccttgaccagcaaattaaagagatcaaagaggtcattgagcttccaatcaaacatccggaactgtttgagagccttggaattgcacaaccaaaggtttgtttacttttttgaagaccatcttaactttggaactttacatgta

SEQ ID NO: 1222 - DNA, 336 bp, Zea mays
cggacgcgtgggcccgaaggcaaatatgtggtggatatagataagagcattgatatcactaagatcacaccttcaacaagagttgctcttcggaatgacagctatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcgcaaccaaagggtgtccttctttatggacctccgggcacaggaaagacattg

SEQ ID NO: 1223 - DNA, 439 bp, Zea mays
  unsure (1)..(439): unsure at all n locations
accttcaacaagagttgctcttcggaatgacagttatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcacaaccaaagggtgtccttctttatggacctccgggcacaggaaagacattgttggcacgtgcggttgctcatcacactgactgcaccttcatcagggtgtctggttctgagttggttcagaagtatattggtgagggctcccggatggttagggaactctttgttatggccanggaacatgcaccatccattatatttatggatgaaattgactctatcgga

SEQ ID NO: 1224 - DNA, 404 bp, Zea mays
ggttcctgattctacatatgatatgattggaggccttgaccagcaaattaaagagatcaaagaggtcattgagcttccaatcaaacatccggaactatttgagagccttggaattgcccaaccaaagggtgtcctcctttatggacctccaggcacaggaaagacattgctggcacgtgcggttgctcatcacactgactgcaccttcatcagggtgtctggttctgaattggttcagaagtatattggtgaaggttcccggatggttcgggaactatttgttatggccagggaacatgcgccatgcatcatgttcatggaagaaagtgactctatcggatctgctagaatggagtctggaactggcaacggtgatagtgaagtgcatcgtacaatgcttgaac

SEQ ID NO: 1225 - DNA, 426 bp, Zea mays
gcaaagttgatccattggtcaatctcatgaaagttgagaaggttcctgattctacttaggatatgattggaggtcttgagcagcaaattaaagagatcaaagaggtcattgagcttccaatcaaacatccggaactatttgagagccttggaattgcacaaccaaagggtgtcctcctttatggacctccaggcacaggaaagacattgctggcacgtgcggttgctcatcacactgactgcaccttcatcagggtgtctggttctgagttggttcagaagtatattggtgaaggctcccggatggttcgggaactctttgttatggccagggaacatgcaccatccattatatttatggatgaaattgactctatcggatctgctagaatggagtctggaactggcaacggtgatagtgaagtgc

SEQ ID NO: 1226 - DNA, 412 bp, Zea mays
cccacgcgtccgattctacctatgatatgattggaggccttgaccagcaaatgaaagggatcaaagaggtcattgagcttccaatcaaacatccggaactgtttgagagccttggaattgcacaaccaaagggtgtccttctttatggaccttcgggcacaggaaagacattgttggcacgtgcggttgctcatcacactgactgcaccttcatcagggtgtctggttctgagttggttcacaagtatattggtgagggctcccggatggttagggaactctttgttatggccagggaacatgcaccatccattatatttatggatgaaattgactgtatcggatctgctagaatggagtctggaactggcaacggtgacagtgaaattcagcgtactatgcttgaacttct

SEQ ID NO: 1227 - DNA, 422 bp, Zea mays
ggaacatgcaccatccattatatttatggatgaaattgactctatcggatctgctagaatggagtctggaactggcaacggtgacagtgaagttcagcgtactatgcttgaacttctaaaccagcttgatggttttgaagcatcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctgaaaaagatcgcggaaaagatgaatggggcctcaggagctgagctcaaggccgtctgcacagaggctggaatgtttgctcttcgtgagagaagggtgcacgtta

SEQ ID NO: 1228 - DNA, 442 bp, Zea mays
cgcacgcgtccgaggtcattgagcttttaatcaaacatccggaactgtgggagagcgttggaattgcacaaccaaagggtgtccttctttatggacctccgggcacaggaaagacattgttggcacgtgcggttgctcatcacactgactgcaccttcatcagggtgtctggttctgagttggttcagaagtatattggtgagggctcccagatggttagggaactctttgttatggccagggaacatgcaccatccattatatttatggatgaaattgactctatcggatctgctagaatggagtctggaactggcaacggtgacagtgaagttcagcgtactatgcttgaactttctaaccagcttgatggttttgaaacatcaaacaaaattaaggttttgatggcaacgaacagaatagacattttggatcaagccct

SEQ ID NO: 1229 - DNA, 376 bp, Zea mays
cccacgcgtccgggtgaaggtcatggggaaatcaaaggttctggtgaaggtacatcccgaaggcaaatatgtggtggatatagataagagcattgatatcactaagatcacaccttcaacaagagttgctcttcggaatgacagctatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcgcaaccaaagggtgtccttctttatggaccttcgggcacaagaaagaca

SEQ ID NO: 1230 - DNA, 419 bp, Zea mays
aagtcattgagcatccaatcaaacatccggaactatttgagagccttggaattgcccaaccaaagggtgtcctcctttatggacctccaggcacaggaaagacattgctggcacgtgcggttgctcatcacactgactgcaccttcatcagggtgtctggttctgaattgggtcacaagtatattggtgaacgttcccggatggttcgggaactctttgttatggccagcgaacatgcgccatccattatatttatggatgaaattgactctatcggatctgctagaatggagtctggaactggcaacggtgatagtgaaatgcagcgtaccatgcttgaacttctaaaccagcttgatggttttgaagcttcaaacaaaattaacgttttgatggcaacaaacagaatatacattttg

SEQ ID NO: 1231 - DNA, 306 bp, Zea mays
gttttagttctactaaagataaagtgttgagtgttctaaatgttaaaagcatgataagtgtagaagttaaataagatctaagttagagttcttgctgtttggactgcatgtccaattttattacgtggctagttaagtaaagtaaaccgtgttttctgtagaaatgttatatataaaacttgtagataatctttttatcttgcttgtgtaaaaatttcatgaccataggttcagtagtttaggagttatgatttttccaagtccagtttcagaatctgtccagattctgtactgatttcgaaaatg

SEQ ID NO: 1232 - DNA, 273 bp, Zea mays
catcaaatgctacttgatcagctctttgacctcaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcagttcgggtaccatcatcaagcctacatggatcagctgaacaacgaggacctggtggac

SEQ ID NO: 1233 - DNA, 453 bp, Zea mays
cccacgcgtccgcccacgcgtccgcccacgcgtccgcacttagcatgaaggagctcgagcagctggaggaccaaatagagatatctctgaagcatatcagctcaagaaagaatcaaatgctacttgatcagctctttgacctcaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcaggtcgggtaccatcatcaagcctacatggatcagctgaacaacgaggacctggtggacccgaatgagcatggtcgatctggatggatatgaaatgctctgatgacccaaaataaagttgatgcacagc

SEQ ID NO: 1234 - DNA, 444 bp, Zea mays
cccacgcgtccggcgccgtctggcccagaaccgtttagctgctaggaaaagccgtctaagagggaaggcatacgttgagcaacttgagaatagcaggctgaaacttagccagttggagcaggagctccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcaacgcacacgccggtgacgacgagctccggcgcatcgtggacggcgtcatggcgcatcaccacgaagcgttcaggctcaagtgcgtggcagccagtgcggacgccttccacgtgctgtcggggatgttgaagacccccgtggagaggtgctttatgtggct

SEQ ID NO: 1235 - DNA, 415 bp, Zea mays
ctaggtcaaaaggcactgcgccgtctggcccagaaccgtgaagctgctaggaaaagccgtggaagaaagaaggcatacgttgagcaacttgagaatagcaggctgaaacttagccagttggagcaggagctccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcaacgcacacgccggtgacgacgagctccggcgcatcgtggacggcgtcatggcgcatcaccacgaagcgttcaggctcaagtgcgtggcagccagggcggacgccttccacgtgctgtcggggatgt

SEQ ID NO: 1236 - DNA, 428 bp, Zea mays
  unsure (1)..(428): unsure at all n locations
cttctcttctccactaccacccgcccgcccgccttctcctccaccactgccccgtcgtggaataggggcaagttcaggcatctcgcttctgtcctggtcgaggggatcggagaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaagtggagcgccggcccttcacggcggaggaggacgcggccatcgtccgcgcccacgcgcgcctcggcaaccgctgggccgncatcgcgcgcctnctncccggccgcaccgacaacgccgtcaagaaccactgg

SEQ ID NO: 1237 - DNA, 363 bp, Zea mays
cttacggtcttctcttctccactaccacccgcccgcccgccttctcctccaccactgcgccgtcgtggaataggggcaagttcaggcatctcgcttctgtcctggtcgaggggatcggagaagaatgggctcggaagcggactgcgacaggatcaggggcccgtggagccccgaggaggacgacgcgctgcggcggctcgtggagcggcacggcgcgcgcaactggacggcgatcgggcgcgagatcccggagcggtcgggcaagtcgtgccgcctgcggtggtgcaaccagctgtcgccgcaagtggagcgccggcccttcacggcggaagaggacgcggccatcgtccgcgcccacgcgcg

SEQ ID NO: 1238 - DNA, 449 bp, Zea mays
gctcggtggatggacgactgaggctgtggcggtggcgctagccagcctcgcatgcgttgttccgggccggtgatggcagtgcccgcacgcgcctgctcccagacgacgacggcagccaccccgcgcgcctgctttggggccgcggcatggccagagcgcgtgctcgcctacccatggcgatgacgcagcccgattccgcagcgtggccagatcccgtgctcgcctgcttgcgcggcgggggcggcccgcgcttgaccgcatctgctcgaccagcgctcacatgcctgctcacggcggtggcggggacggcctgcgcgcctgctcgcatgctgggcggcaggggcgctcgcccgcgcgctcgcggccatggcggtgctcgcacgtgtgcttgtctgcgacagcacacgcctgcgcgcttggttgtggcgacgcccgcttgcgtttcgtgc

SEQ ID NO: 1239 - DNA, 445 bp, Zea mays
gcggacgcgtcctccggacgcgtgggcggtctcgttggctctcggtgctcttctacacccaggtccctcctaacatcttctgcaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtct

SEQ ID NO: 1240 - DNA, 311 bp, Zea mays
cccacgcgtccgcggacgcgtggggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtcttcgaagaa

SEQ ID NO: 1241 - DNA, 424 bp, Zea mays
gcgatcaatgatcttcttatacaggttactgctaattctgttcggttagtcagttgggcctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctggtgggatgtggacagatataagtgttagaatattttcacttccagatcttgaattgataaggaaggaaaatttgggtggagaaattgttcctcggtctggtctgctgtgcaccttggaaggggtttcgtatttgc

SEQ ID NO: 1242 - DNA, 386 bp, Zea mays
cggcaggcaactgcgtaccggcgaggtgatctgtcagtcgtcgcgggtcgtagcacgcgtcgacaacaggctgttccaattaggcctgaagaaatacggcaagggggactggaggaacatatcgcgcaactacgtccagacgcggacgcccacgcaggtggccagccacgcgcagaagtacttcatcaggctcaactccggcggcaaggacaagaggaggtccagcatccacgacatcaccacggtgaacctgacggacgacgagcgggcgccctcgccgtcgcggtcctctctgatcaccaccaccaccagccatccaaacgcgccggctccggccgcagtggtgatacgcggtcccttctcgtcctcgtcggcggcggtggccg

SEQ ID NO: 1243 - DNA, 290 bp, Zea mays
tctcctcctttttctccactccgcttttgcttggttccatcgggccggagaggagaagctagctaactagcagcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaa

SEQ ID NO: 1244 - DNA, 395 bp, Zea mays
atcctatttctccactccgcttttgcttggttccatcgggccggagaggagaagctagctaactagcagcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtaacggaccgagcatcacgagaacacttgagaggtaaaaaaaaaacagttatgcaggcccagatactgctgtacagaacaaagag

SEQ ID NO: 1245 - DNA, 302 bp, Zea mays
gtatttatattctctccttaattccccatctttctcctccgccttcgcctcctccgcatccctcgccttcctccgcccaagcctctgttctcctccggctgccgaaaccctagccgcctccgccgtcatggcgagcagcaacgtctccaccgtctacatctccgtcatcgatgacgtcatctccaaggtccgcgaggatttcatcacctacggagtcggcgacgccgtcctaaacgagctccaggctctctgggagatgaaaatgctgcactgtggcgcgatctcggggaacatagagcgaa

SEQ ID NO: 1246 - DNA, 208 bp, Zea mays
atccggctgccgaaaccctagccgcctccgccgtcatggcgagcagcaacgtctccaacgtctacatctccgtcatcgatgacgtcatctccaaggtccgcgaggacttcatcacctacggagtcggcgacgccgtcctaaacgagctccaggctctctgggagatgacaatgctgcactgtggcgcgatctcggggaacatagagcg

SEQ ID NO: 1247 - DNA, 314 bp, Zea mays
caatttgttgacatatgaatgcgtgaagcattggatcccaaagaactccaaaatgcgataaggccttgaatggactagtatcatgattgggagaccatcctgagaagctccatcaagcatgccttgttcacgcgtttcttaagaggcccttttcctgcactgttgatggttgcccctttagctatagcaggaaggctcatttgaacagacatttacttactcatgaagggaaactatttgtgtgccctgtcgaaggatgtggccgtaagttcaatatcaagggtaatatgcagagacatgttcaggaaatccac

SEQ ID NO: 1248 - DNA, 260 bp, Zea mays
gcgtgaagcattggatcccaaagaactccaaaatgcgataaggccttgaatggactagtatcaggattgggagaccatcctgagaagctccatcaagcatgccttgttcacgcgtttcttaagaggcccttttcctgcactgttgatggttgcccctttagctatagcaggaaggatcatttgaacagacatttacttactcatgaagggaaactatttgtgtgccctgtcgaaggatgtggcgtaagttcaatatcaag

SEQ ID NO: 1249 - DNA, 321 bp, Zea mays
cttctccatcccacgcgcgcgcaggccaaggccggatcggcggcctctcagatctcgccggccgccgtgagacagagaccgaagggagggttgaccggtgctcgggaggaagatgtctagcgggacgcagcagaagtgcaaggtgtgcaccaagacggtgtacccgatggaccagctctccaccgacggcgtcgtcttccaccgctcctgcttcaagtgccagcactgcaagtctaccctctcactgagcaactattcctcgttcgaaggagtgccgtactgcaagacccatttcgagcagctgttcaaggagaccgggag

SEQ ID NO: 1250 - DNA, 316 bp, Zea mays
cccacgcgtccgcttctccatcccacgcgcgcgcaggccaaggccggatcggcggcctctcagatctcgccggccgccgtgagacagagaccgaagggagggttgaccggtgctcgggaggaagatgtctagcgggacgcagcagaagtgcaaggtgtgcaccaagacggtgtacccgatggaccagctctccaccgacggcgtcgtcttccaccgctcatgcttcaagtgccagcactgcaagtctaccctctcactgagcaactattcctcgttcgaaggagtgccgtactgcaagacccatttcgagcagctg

SEQ ID NO: 1251 - DNA, 359 bp, Zea mays
gcaaaccgaacgaacccaaccgaagcgagagctgagcaaggcagatgcggcgtgaccggcgatggagcggctgcagcggatgctttggcgcctccggcatggggcagccgccgacggactcgccgctgctcgattcctccgagcaggtctacatctcctccctagcgcttctcaagatgtctcaagcacgggagggctggggtgcccatggaggtcatgggcctcatgctcggcgagttcgtcgacgactacaccgtcagggtcgtcgacgtcttcgccatgccgcatagcgtgactggtgtcagcgtcgaggccgtagaccacgtcttccagacaaacatgctttttatgcttaagca

SEQ ID NO: 1252 - DNA, 265 bp, Zea mays
aagtgcaccgcctgcgacaagacggtgtacctcgtcgacaagctcaccgccgacaaccgcgtctaccacaaggcctgcttccgctgccaccactgcaagggcacactcaagctcgccaactacaactccttcgacggagtgctctactgcaggcctcacttcgaccagctcttcaagaggaccgggagcttggacaagagcttccaaggaaccccaaaggttgtcaagccagaaagaaacgttgggaatgagaatgctactaaag

SEQ ID NO: 1253 - DNA, 414 bp, Zea mays
  unsure (1)..(414): unsure at all n locations
agccagtcagccacatcactagcgatctgtgcagaggcaatggcgtccaaggttgggctgggggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaagcgganggcgagggcggcgccgtcgtcagctgggccatggagttcgacaag

SEQ ID NO: 1254 - DNA, 232 bp, Zea mays
gcacgagacattgcgcacgaggggaagctgtactgcaagcaccaccacatccagctgatcaaggagaaggggaacttcagccagcttgagaatgaccacgagaagacatcacaggctgggtcactggaggaggatgaacaagagtattgatcactgagcacaaccacagatgaataatgaatcctcttgcatttgcctagagcactatgtatttctgtggcgtggttcgatt

SEQ ID NO: 1255 - DNA, 312 bp, Zea mays
caagtctcgagcgccttcgctggcaccagggagaagtgtgtcggatgcagcaagacagtctatccaattgagagggttactgtgaacaacaccatgtaccacaagtgctgcttcaagtgctgccatggaggatgcaccatcagcccttctaactacatcgcgcacgaggggaagctctactgcaagcaccaccacgtccagctgatcaaggagaaagggaacttcagccagctcgagaatgaccacgagaagacatcgcaggctgggtcgctggaggacgacgaagaagaagagtattaattaatcgctgag

SEQ ID NO: 1256 - DNA, 250 bp, Zea mays
accaccacatccagctgatcaaggagaaggggaacttcagccagcttgagaatgaccacgagaagacattgcgcacgaggggaagctgtactgcaagcaccaccacatccagctgatcaaggagaaggggaacttcagccagcttgagaatgaccacgagaagacatcacaggctgggtcactggaggaggatgaacaagagtattgatcactgagcacaaccacagatgaataatgaatcctcttgcat

SEQ ID NO: 1257 - DNA, 304 bp, Zea mays
cagggagaagtgtgtcggatgcagcaagacagtctatccaattgagagggttactgtgaacaacaccatgtaccacaagtgctgcttcaagtgctgccatggaggatgcaccatcagcccttctaactacatcgcgcacgaggggaagctctactgcaagcaccaccacgtccagctgatcaaggagaaagggaacttcagccagctcgagaatgaccacgagaagacatcgcaggctgggtcgctggaggacgacgaagaagaagagtattaattaatcgctgagcaaaaatacataccacca

SEQ ID NO: 1258 - DNA, 305 bp, Zea mays
cagcaagacagtctatccaactgagagggtcactgttaataacactatgtaccacaagagctgcttcaagtgctgccatggagggtgcaccatcagcccttctaactacattgcgcacgaggggaagctgtactgcaagcaccaccacatccagctgatcaaggagaaggggaacttcagccagcttgagaatgaccacgagaagacatcacaggctgggtcactggaggaggatgaacaagagtattgatcactgagcacaaccacagatgaataatgaatcctcttgcatttgcctagagcac

SEQ ID NO: 1259 - DNA, 261 bp, Zea mays
tcaagcgcctttgctggcaccagagagaaatgtgttggatgcagcaagacagtctatccaactgagagggtcactgttaacaacactatgtaccacaagagctgcttcaagtgctgccatggagggtgcaccatcagcccttctaactacattgcgcacgaggggaagctgtactgcaagcaccaccacatccagctgatcaaggagaaggggaacttcagccagcttgagaatgaccacgagaagacatcacaggctggg

SEQ ID NO: 1260 - DNA, 266 bp, Zea mays
gaacaagagtattgatcatcctcctccagtgacccagcctgtgatgtcttctcgtggtcattctcaagctggctgaagttccccttctccttgatcagctggatgtggtggtgcttgcagtacagcttcccctcgtgcgcaatgtagttagaagggctgatggtgcaccctccatggcagcacttgaagcagctcttgtggtacatagtgttattaacagtgacctggatgcttaaccggtgagttgcaatcagcatactgatatt

SEQ ID NO: 1261 - DNA, 438 bp, Zea mays
cagaggcatcttctgaccaatgaaaatggtgaaaccaggtagagtatctgactcaaagataacaacgtttacatgcagatacaagacaacaatatcattgttctctgaacacacatgacctccattgtgacccagcctgtgatgtcttctcgtggtcattctcaagctggctgaagttccccttctccttgatcagctggatgtggtggtgcttgcagtacagcttcccctcgtgcgcaatgtagttagaagggctgatggtgcaccctccatggcagcacttgaagcagctcttgtggtacatagtgttgttaacagtgacctggatgcttaaccggttgtcaagtgaagaaggctcaaactaccggaagaatgattgagatggttgaacacagaatcttaccctctcagttggatagactgtcttgctgcatccaa

SEQ ID NO: 1262 - DNA, 259 bp, Zea mays
gttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaaggaaaatgtgttgttctgaagacctccacaagacaaactatattccttcctgttgttgggctagtggaccctgacaagctaaagcctggtgatctggttggagtc

SEQ ID NO: 1263 - DNA, 301 bp, Zea mays
tgataagcagattcaagagcttgtagaggcaattgtactgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggagcaaagcttgtccgggatgcattccagcttgccaaagagaaagctccttgtattatatttattgatgagatagtgccattg

SEQ ID NO: 1264 - DNA, 298 bp, Zea mays
gacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagctcaaca

SEQ ID NO: 1265 - DNA, 295 bp, Zea mays
cctccagctccgaaaccctactccgccggcgatgtcgtcatccggcgccccggccccggcggcggcaatggccgttgacgacgccgaagacgaccagctcgcctccatgtccacggaggatatcatccgggcctcccgccttcttgacaacgagatccgtgtcctcaaggacgagttgcagcggacgaacctggaattggagtcgttcaaggagaagattaaggaacaccaagagaaaattaagctcaacaagcagctgccctacctcgttggcaacatcgttgagatcttggaa

SEQ ID NO: 1266 - DNA, 292 bp, Zea mays
ctcgcgacagagggaaaaaaactcagaaacccaactcgctcgttcccgcaactcgcatcttctcgtcgacagctccaactccggaacccttgtcgccggcgccggcgatgtcgtcatctaccgcccccgccccggcggcggcgatggccgtggacgatgcggaggacgaccagctcgcctccatgtccacggaggacgacatccgggcctcccgcctcctcgacaacgagatccgcgtcctcaaggacgagttgcagcggacgaacctggagttggagtcgttcaaggagaa

SEQ ID NO: 1267 - DNA, 312 bp, Zea mays
agctgaggaggatggtgctaacattgatttagactcacaaaggaaaggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgac

SEQ ID NO: 1268 - DNA, 235 bp, Zea mays
ggacctggcgcagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagt

SEQ ID NO: 1269 - DNA, 233 bp, Zea mays
ccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagaga

SEQ ID NO: 1270 - DNA, 239 bp, Zea mays
cgcagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacga

SEQ ID NO: 1271 - DNA, 172 bp, Zea mays
ctgaagacatccaccagacaaaccatattccttcctgtaattgggttagttgaccccgataagctaaagcctggcgatttagttggagttaacaaagacagctacttgatactagatacattgccttcagagtatgactcacgggttaaggcaatggaagtagatgagaaac

SEQ ID NO: 1272 - DNA, 247 bp, Zea mays
gcacagacgaatgcaacgtttcttaaattagctggtccacaacttgtgcagatgtttattggtgatggagcaaagcttgtccgggatgcattccagcttgccaaagagaaagctccttgtattatatttattgatgagatagatgccattggcaccaaacgttttgatagtgaagttagcggtgatagagaagttcagcggacaatgttggaattattgaatcaactggatggattcagcagcgatg

SEQ ID NO: 1273 - DNA, 302 bp, Zea mays
ccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagatggagtcgttcaaggagaagattaaggaaaaccaagagaaaattaagctcaacaagcagctgccctacctcgttggcaacatcgttgagatcttggaaatgaaccctgaggatg

SEQ ID NO: 1274 - DNA, 263 bp, Zea mays
atccgggcctcccgccttcttgacaacgagatccgtgtcctcaaggacgagttgcagcggacgaacctggagttggagtcgttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaaggaaaatgtgttgttctgaagacctccac

SEQ ID NO: 1275 - DNA, 279 bp, Zea mays
atccgggcctcccgccttcttgacaacgagatccgtgtcctcaaggacgagttgcagcagacgaacctggagttggagtcgttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaaggaaaatgtgttgttctgaagacctccacaagacaaactatattc

SEQ ID NO: 1276 - DNA, 260 bp, Zea mays
cccacgcgtccgcgcagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagt

SEQ ID NO: 1277 - DNA, 303 bp, Zea mays
aaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagctcaacaagcagctgc

SEQ ID NO: 1278 - DNA, 289 bp, Zea mays
acaacgcagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagatttaccaaaaccaaga

SEQ ID NO: 1279 - DNA, 266 bp, Zea mays
gccgtacctcgtcggcaacatcgtcgagattttggaaatgaaccctgaggatgaggctgaagaagatggtgctaacatcgatctggactcacaaaggaaaggaaaatgtgttgttctgaagacatccaccagacaaaccatattccttcctgtaattgggttagttgaccccgataagctaaagcctggcgatttagttggagttaacaaagacagctacttgatactagatacattgccttcagagtatgactcacgggttaagg

SEQ ID NO: 1280 - DNA, 292 bp, Zea mays
cagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaa

SEQ ID NO: 1281 - DNA, 290 bp, Zea mays
aaaactcagaaacccaactcgctcgttcccgcaactcgcatcttctcgtcgacagctccaactccgcgaacccttgtcgccggcgccggcgatgtcgtcatctaccgcccccgccccggcggcggcgatggccgtggacgatgcggaggacgaccagctcgcctccatgtccacggaggacgacatccgggcctcccgcctcctcgacaacgagatccgcgtcctcaaggacgagttgcagcggacgaacctggagttggagtcgttcaaggagaagatcaaggaaaacc

SEQ ID NO: 1282 - DNA, 177 bp, Zea mays
gtcgtacctcgtcggcaacatcgtcgagattttggaaatgaaccctgaggatgaggctgaagaagatggtgctaacatcgatctggactcacaaaggaaaggaaattgtgttgttctgaagacatccaccagacaaaccatattcctttctattattgggttagttgaccccgataa

SEQ ID NO: 1283 - DNA, 213 bp, Zea mays
cgcagacaaaccgaactcgcacctcgcacctcgcatcgtcttgtcgacacacctccagatccgaaaccctactccgccggcgatgtcgtcatccagcgcaccggccccggcggcggcaatggccgttgacgacgcggaggacgaccagctcgcctccatgtccacggaggatatcatccgggcctcccgcattcttgacaacgagatccgtgt

SEQ ID NO: 1284 - DNA, 300 bp, Zea mays
aacaacgcagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaag

SEQ ID NO: 1285 - DNA, 294 bp, Zea mays
caaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagctcaa

SEQ ID NO: 1286 - DNA, 282 bp, Zea mays
aaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagatcaaggaaaaccaagagaaa

SEQ ID NO: 1287 - DNA, 269 bp, Zea mays
ggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgactgcaatggaagtggattcaaagcccactgaagattataatgacattgggggtcttgaaaagcagattcaagagcttgtagaggcaattgtactgcccatgacaca

SEQ ID NO: 1288 - DNA, 289 bp, Zea mays
ccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatcgggccttcccgccttcttgacagagatcggtctccacaaggacgagttgcagcggacgaacctggagttggagtcgttcaaggagaagattacggaaaaccaagagaaaattaagctcaac

SEQ ID NO: 1289 - DNA, 424 bp, Zea mays
  unsure (1)..(424): unsure at all n locations
cgacagagggaaaaaaactcagaaacccaactcgctcgttcccgcaactcgcatcttgctcgtcgacagctccaactccggaacccttgtcgccggcgccggcgatgtcgtcatctaccgcccccgccccggcggcggcgatggccgtggacgatgcggaggacgaccagctcgcctccatgtccacggaggacgacatccgggcctnccgccttctcgacaacgagatccgcgtcctcaaagacgagttgcagcggacgaacctggaattggagtccgtcaaggagaagatcaaggaaaaccaggagaaaattaagctcaacaaacagctaccctaacctcgtggcaatttcgttgagatcttggaaatgaatcctgaggatgaagctaaggaggatggtgctaacattgatttagattcaca

SEQ ID NO: 1290 - DNA, 417 bp, Zea mays
ctgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggagcaaagcttgtccgggatgcattccagcttgccaaagagaaagctccttgtattatatttattgatgagatagatgccattggcaccaaacgttttgatagtgaagttagcggtgatagagaagttcagcggacaatgttggaattattgaatcaactggatggattcagcagcgatgagagaataaggtcatagctgcaactaaccgtgctgacatccttgaccctgctctga

SEQ ID NO: 1291 - DNA, 300 bp, Zea mays
gcagacaaaccgaactcgcacctcgcacctcgcatcgtcttgtcgacacacctccagctccgaagccctgctccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccatgagaaaattaagctcaac

SEQ ID NO: 1292 - DNA, 415 bp, Zea mays
gcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaagaactggcaagacactcatggctcgtgcatgtgctgcacagacgaatgcaacgtttcttaaattaactggtccacaacttgtgcagatgtttattggtgatggagcaaagcttgtccgggatgcattccagcttgccaaagagaaagctccttggattatattt

SEQ ID NO: 1293 - DNA, 433 bp, Zea mays
caagacaaactatattccttcctgttgttgggctagtggaccctgacaagctaaagcctggggatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggaacaaagcttgtccgggatgcatt

SEQ ID NO: 1294 - DNA, 371 bp, Zea mays
tcatcagggcctcccgtctcctcgacaacgagatccgcgtccacaaggacgagctgcagcggtcgaacctggagctggagtctatcaaggagaagaccaaggagaaccaggagaagattaagctcaacaagcagctgccgtacctcgtcggcaacatcgtcgagattttggaaatgaaccctgaggatgaggctgaagaagatggtgctaacatcgatctggactcacaaaggaaaggaaaatgtgttgttctgaagacatccaccagacaaaccatattccttcctgtaattgggttagttgaccccgataagctaaagcctggcgatttagttggagttaacatagacagctacttgatactagataca

SEQ ID NO: 1295 - DNA, 531 bp, Zea mays
  unsure (1)..(531): unsure at all n locations
gcgactcatacacggtcctacccagtctccatcgacaatcgaggatctcgacgtctcacaaggactgatgctgcagtcggtctgaacactggggagctggtagtcttatgcaaggcagaatgaccacaggtagaacacatgagaagtattaatgctcaacaagcatgctgtccgtacactatgtcggctacatctgtcgagatttatggaaantgaacgcctgatggattgaggcttgacagaatgatggtagctaaccatctgatcgtgagactcacagaaggaataggataaatgtgtatggtctagaagaccatccactcagacaagaccatanttccgttcctgtaatatgggttagattgatccccgataagactagaagccatggcgaatttagtatggagttaacataagaacagctacgttgatacttagataccattgcgcttcaggagtattgactcacagggttaagtgcaatggtaagtagcatgagaaaacctaactgagggattacaaaatgacatt

SEQ ID NO: 1296 - DNA, 468 bp, Zea mays
tcatcagggcctcccgtctcctcgacaacgagatccgcgtccacaaggacgagctgcagcggtcgaacctggagctggagtctatcaaggagaagaccaaggagaaccaggagaagattaagctcaacaagcagctgccgtacctcgtcggcaacatcgtcgagattttggaaatgaaccctgaggatgaggctgaagaagatggtgctaacatcgatctggactcacaaaggaaaggaaaatgtgttgttctgaagacatccaccagacaaaccatattccttcctgtaattgggttagttgaccccgataagctaaagcctggcgatttagttggagttaacaaagacagctacttgatactagatacattgccttcagagtatgactcacgggttaaggcaatggaagtagatgagaaacctactgaagattacaatgacattggcggacttgagaaacagattc

SEQ ID NO: 1297 - DNA, 519 bp, Zea mays
aagatgtatataaaattattagaaattttcatcgagtcgatgtagttgactgatgtaccggcttggactgcggccgaaatcacggcctcccgactcctcgacaactagatccgagtttcaaggactagctgcaacggtcggacctggggcaatagacgatggacgagaagaccaaggagaaccaggagaagattaagctcaacaagcagctaccgtacctcgtcggcaacatcgtcgagattttggaaatgaaccctgaggatgaggctgaagaagatggtgctaacatcgatctggactcacaaaggaaaggaaaatgtgttgttctgaatacatacaccagacaaaccatattacttcctgtaattggattagttgaccccgataagctaaagcctgacgatttagatgcagttaacaaagacagctacttgatactagatacattgccttcagagtatgactcacggattaaggcaatggaagtagatgagaaacctactgaagattacaatgaca

SEQ ID NO: 1298 - DNA, 410 bp, Zea mays
ggaaaaccaagagaaaattaagctcaacaagcagctgccctacctcgttggcaacatcggtgagatcttggaaatgaaccctgaggatgaagctgaggaggatggtgctaacattgatttagactcacaaaggaaaggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgaaggcaatggaagtggatgaaaagcccacttgagaatattatgacattgggggtcttgaaaagcagattcaagagcttgtagaggcaattgtactggccatgacacataaag

SEQ ID NO: 1299 - DNA, 308 bp, Zea mays
tgcatgctccacagggcctgcttgatctttcaggtgggcagacacatataggaatcaagagaatgggagagcttgatctaaaagcattttcaaaggcatgccaaaaggagcgtacagaaaatgcagaagttactgctgcctttctttgttcaaagtgggaggctgaaataaaaaatcctgactggcacccttttagggtcgtcacaattgatggaaaggagatggcaataatcgaggatgatgcaaagcttcgagcactcaaagaagaacatggagaagaaatctatgcaatggtgacaaaggcgctg

SEQ ID NO: 1300 - DNA, 269 bp, Zea mays
tgcagacacatgtaggaatcaagagaatgggagagcttgatctaaaagcattttcaaaggcatgccaaaaggagcgtacagaaaatgcagaagttactgctgcctttctttgttcaaagagggaggctgaaataaaaaatcctgacaggcacccttttagggtcgtcacaattgatggaaaggagatggcaataatcgaggatgatgcaaagcttcgagcactcaaagaagaacatggagaagaaatctatgcaatggtgacaaaggcg

SEQ ID NO: 1301 - DNA, 252 bp, Zea mays
gaatgggagagcttgatctaaaagcattttcaaaggcatgccaaaaggagcgtacagaaaatgcagaagttactgctgcctttctttgttcaaagtgggaggctgaaataaaaaatcctgactggcacccttttagggtcgtcacaattgatggaaaggagatggcaataatcgaggatgatgcaaagcttcgagcactcaaagaagaacatggagaagaaatctatgcaatggtgacaaaggcgctgcttg

SEQ ID NO: 1302 - DNA, 245 bp, Zea mays
gctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacgaggaggccacggagcaggtgggcaaggtgaagattgtggcatgtgattccaaattgctcggacaataggcctgtgtaccctcgaggt

SEQ ID NO: 1303 - DNA, 190 bp, Zea mays
ctttcccgcggcgacggtgacgacgaccgcgcgacgccgccgactccctactgcatcaggtgcctcggccttcgtcgtgctctccgccggcaacgagtatagacgggcgcgcatggccaccttcgagctgtaccggagtccaccatcggcatgtgcctcaccgagacgctcgacgagatggtctccaacg

SEQ ID NO: 1304 - DNA, 231 bp, Zea mays
ccgcggcgacggtgacgacgaccgcgcgaggccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcg

SEQ ID NO: 1305 - DNA, 225 bp, Zea mays
ccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaa

SEQ ID NO: 1306 - DNA, 237 bp, Zea mays
cacctgctctctctctctctccctttctttcccgcggcgacggtgacgacgaccgcgcgacgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctc

SEQ ID NO: 1307 - DNA, 286 bp, Zea mays
gtcacctgcacacctacaggttctgtgacaatgtgtggaccttcatcttgacagacgcaagcttcaagaacgaggaggccacggagcaggtgggcaaggtgaagattgtggcatgtgattccaaattgctcggacaataggcctgtgtaccctcgaggtcaaggaaggaagcttttaagtgcggcgaggcggggtctgtctgcgcgtcagctgtacacgcctaggctaccgcgaggcggggtctgtctgcgtcactgtacacgcctaggctaccgcccgaacggca

SEQ ID NO: 1308 - DNA, 275 bp, Zea mays
ctttctttcccgcggcgacggtgacgacgaccgcgcgacgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtg

SEQ ID NO: 1309 - DNA, 185 bp, Zea mays
atagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaacgtgtggaccttcatcttgacag

SEQ ID NO: 1310 - DNA, 278 bp, Zea mays
cggtgacgacgaccgcgcgacgccgccgactccctactgcatcaggtgcctcggccttcgtcgtgctctccgcaggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaag

SEQ ID NO: 1311 - DNA, 352 bp, Zea mays
tagcgacaggtcacgataaaccgcgcgagccgcgccaactccctactgcatgaggtgcctcggccttcgtcgtgctctccgccggcaacgagtatagactggcgcgcatgggcagcttcgagctgtaccggatgtccaccatcggcatgtgcctcaccgagacgctcgacgatatggtctccaacggtaccctcagcccggagctcgctatccaggtcctcgtccagttcgacatgtccatgacggatgctctggacaaccaagtgaacagcaaggttactgtcaagggtcacctgcacacctacacgttctgtgacaatgtgtggaccttcatcgtgacagacgcaagctt

SEQ ID NO: 1312 - DNA, 425 bp, Zea mays
cggacgcgtgggctgacgcgtgggtccagttctacaagtccatgacggatgctggggacagggaagtgaagagcaaggttactgtcaagggtcacctgcacacctacaggttctgtgacaacgtgtggaccttcatcttgacagacgcaagcttcaagaacgaggaggccacggagcaggtgggcaaggtgaagattgtggcatgtgattccaaattgctcggacaataggcctgtgtaccctcgaggtcaaggaaggaagcttttaagtgcggcggtgcggtgtctgtctgcgcgtcagctgtacacgcctaggctacctgccgaggcggtgtctgtctgcttcagctgtacacgcctaggctaccggccgaaacggatttcatttgccttcttcgtactggatgtgtatcttcatttattttt

SEQ ID NO: 1313 - DNA, 317 bp, Zea mays
cccacgcgtccgcccacgcgtccgctcagcccggagctcgctatccaggtcctcgtccagggggacaagtccatgacggatgctctggagaaccaagtgaagagcaaggttactgtcaagggtcacctgcacacctacaggttctgtgacaacgtgtggaccttcatcttgacagacgcaagcttcaagaacgaggaggccacggagcaagtgggcaaggtgaagattgtggcatgtgattccaaattgctcggacaataagcctgtgtaccctcgaggtcaaaggaaggagcttttaagtgccgccgggccgggtc

SEQ ID NO: 1314 - DNA, 386 bp, Zea mays
cccacgcgtccgcccacgcgtccgccgcggcgacggtgacgacgaccgcgcgagcgccggcgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacga

SEQ ID NO: 1315 - DNA, 281 bp, Zea mays
agcagctcgattcgtccttgaagcacataagatctacaaggacacaacacatggttgatcaactgacagaacttcagaaaaaagaacaaatgttttgtgaagcaaataagtgtcttcgaagaagactggaggagagcaaccaggttatatggcagcatgcgtgggagcaaagcgcgcggcattctgaagtgcagccgcagcagctcaatggcaataacttcttccatcccctcgatggtgctggtgaacccacccttcagatagggtatccttcagaggca

SEQ ID NO: 1316 - DNA, 278 bp, Zea mays
catgagatctacaaggacacaacacatggttgatcaactgacagaacttcagaaaaaagaacaaatgttttgtgaagcaaataagtgtcttcgaagaagactggaggagagcaaccaggttatatggcagcatgcgagggagcaaagcgagcggcattctgaagtgcagccgcagcagctcaatggcaataacttcttccatcccctcgaaggagctggtgaacccacccttcagatagggtatccatcagaggcactgactagctcatgcatgacca

SEQ ID NO: 1317 - DNA, 425 bp, Zea mays
cggacgcgtgggcggacgcgtgggcggacgcgtgggacagaacttcagaaaaaagaacgaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgccatgagatcgaactactgcgcaattccgaattaataagcatggccgcatgcagctgcctgtgctatacgttgtgcttggagtgtactttaaggttcttgcatggccagtatgtgtgtaacatttgtgatg

SEQ ID NO: 1318 - DNA, 351 bp, Zea mays
gaagaagcgaatggatgatgaagctaagaaggcttctcggcttgagcagaagattaagcttctgacacaaggatatcagatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaggtcgaggagcacaagaggcaactcaaggtacaagaggcggtaga

SEQ ID NO: 1319 - DNA, 273 bp, Zea mays
caaggatatcagatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaggtcgaggagcacaagaggcaactcaaggtacaa

SEQ ID NO: 1320 - DNA, 413 bp, Zea mays
  unsure (1)..(413): unsure at all n locations
ccaagcctctactgtaaatctgataagattctgctttgcaaaatgagtttgaaactgtgaataagcgaatggatgatgaagctaacaaggcttctcggcttgagcagaacattaagcttctgacacaaggatatcatatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaagtctatgagcacaagangcaactcaaggtacaagangcggtataagcc

SEQ ID NO: 1321 - DNA, 348 bp, Zea mays
aaatgaacttgatgcgtggcattgatctgaaaaagatcgcggaaaagatgaatggggcctcaggagctgagctcaaggccgtctgcacagaggctggaatgtttgctcttcgtgagagaagggtgcacgttacccaggaggacttcgagatggcagtggccaaggtgatgaagaaagacacggagaagaacatgtccctgcgcaagctctggaagtgaggctcgtgcctacctttcacagccttcccgaagctagtggcagtgccttcatatccatatcttttaccaaagcagtggaatggcgtaacggcatgctctggacaatgttatctcaagttgcgccgcgcat

SEQ ID NO: 1322 - DNA, 288 bp, Zea mays
gatccattcaagaaaaatgaacttgatgcgtggcattgatctgaaaaagatcgcggaaaagatgaatggggcctcaggagctgagctcaaggccgtctgcacagaggctggaatgtttgctcttcgtgagagaagggtgcacgttacccagaggacttcgagatggcagtggccaaggtgatgaagaaagacacggagaagaacatgtccctgcgcagctctggaagtgaggctcgtgctacctttcacagccttcgcgaactagtggcagtgcttcatatccatatc

SEQ ID NO: 1323 - DNA, 285 bp, Zea mays
gatccattcaagaaaaatgaacttgatgcgtggcattgatctgaaaaagatcgcggaaaagatgaatggggcctcaggagctgagctcaaggccgtctgcacagaggctggaatgtttgctcttcgtgagagaagggtgcacgttacccaggggacttcgagatggcagtggccaaggtgatgaagaaagacacggagaagaacatgtccctgcgcaactctggaagtgaggctcgtcctacctttcacagcttcccgagctagtggcagtgccttcataccata

SEQ ID NO: 1324 - DNA, 321 bp, Zea mays
tgcggaaaagatgaatggggcctcaggagctgagctcaaggccgtctgcacagaggctggaatgtttgctcttcgtgagagaagggtgcacgttacccaggaggacttcgagatggcagtggccaaggtgatgaagatagacacggagaagaacatgtccctgcgcaactctggaagtgaggctcgtgcccaccgttcacggcctccccgaagctagtggcagtgccttcatatccatatcttttaccaaagcagtggaatggtgtaacggcatgctctggacaatgttatctcaagttgcgccgcgcatgcttatgttta

SEQ ID NO: 1325 - DNA, 321 bp, Zea mays
gaagaagcagcgcacaggtggcagggatgggtcgcggcggttttggggacggtggagttgctcgcggtgaaaatggtgagggtaggcaggcagagaggggccgtgggcccgccagccttaccgtggaggtgggcgacgtggtgggtacagcgatgggcaggctgggaatgagttcggacgtcctcgccgggcatatgagcgccacagcggcacaggccgtggctacgggatgaagcgtgaaggggctgggcgtggaaattggggaactgcaactgatgaaggccttgaacaggacactgtggatgctgttaatcctgagga

SEQ ID NO: 1326 - DNA, 234 bp, Zea mays
ggacgggctcgcggtgaaaatggtgagggtaggcaggcagagaggggacttgggcccgccagccttaccgtggaggtgggcgacgtggtgggtacagcgatgggcaggctgggaatgagtttggacgtcctcgccgggcatatgagcgccacagcggcacaggccgtggctacgggatgaagcgtgaaggggctgggcgtggaaattggggaactgcaactgatgaaggccttg

SEQ ID NO: 1327 - DNA, 291 bp, Zea mays
ggggggacggtggagttgctcgcggtgaaaatggtgagggtaggcaggcagagaggggccgtgggccccgccagccttaccgtggaggtgggcgacgtggtgggtacagcgatgggcaggctgggaatgagttcggacgtcctcgccgggcatatgagcgccacagcggcacaggccgtggctacgggatgaagcgtgaaggggctgggcgtggaaattggggaactgcaactgatgaaggccttgaacaggacactgtggatgctgttaatcctgaggagactactgccg

SEQ ID NO: 1328 - DNA, 282 bp, Zea mays
ggcacttgtgcaaggctaaatgaggaacttgctgaaacaagccttaagctcaggcagatgagaggagatgagctccagaggctgagcgtcgaacagctgcaggagctcgagaagaccctcgaatccggcctcggctctgtactcaaaaccaagagccagaaaatccttgacgagatcagcggtctggaaagaaagagaacgcagctgatcgaggagaactcaaggctgaatgagcaagtgacacggatgtcgatgatggagacgcagcttggcgccgatcca

SEQ ID NO: 1329 - DNA, 203 bp, Zea mays
cccacgcgtccggagctccagaggctgagcgtcgaacagctgcaggagctcgagaagaccctcgaatcaggcctcggctctgtactcaaaaccaagagccaaaaaatccttgacgagatcagcggtctggaaagaaagagaacgcagctgatcgaggagaactcaaggctgaaggagcaagtgacacggatgtcgaggatgga

SEQ ID NO: 1330 - DNA, 264 bp, Zea mays
ggaaaaactcttcttgccaaggctgtggctaactcaacatctgcgactttcttgcgtgttgttggtagtgaactcattcaaaagtaccttggggatggtcccaaactagtccgagaattgtttagggtggctgatgaactttctccctcaattgtctttattgatgagattgacgctgttggaacaaagaggtatgatgctcattcaggaggagagcgtgagattcaaagaactatgttggagctgctgaatcagctagatggt

SEQ ID NO: 1331 - DNA, 301 bp, Zea mays
agacgctgttgagcttcccttgactcatcctgagttgtatgaagacattgggatcaggccacccaagggagtcatattatatggcgaacctggaactggaaaaactctactcgccaaggctgttgccaattcaacatctgcgactttcttgcgtgttgtcggtagtgaacttattcaaaagtaccttggggatggtcccaagctagtcagagaattgtttagggtggctgatgaactttctccctcaatagtcttcattgatgagattgacgcagttggaacgaagaggtatgatgctcat

SEQ ID NO: 1332 - DNA, 202 bp, Zea mays
tgctcattcaggaggagagcgtgagattcaaagaactatgttggagctgctgaatcagctagatggttttgactcgcgtggagatgttaaagttattctagcaacaaaccgcattgaaagtcttgatcctgctttgcttcggccaggccgtatagaccggaagattgaattccctctcccagatattaaaactagaagacgc

SEQ ID NO: 1333 - DNA, 312 bp, Zea mays
gaaattaaagaggcagttgagcttcccttgactcaccctgagctgtatgaagacattggtattaggcctcccaagggagtcatattatatggagaacctggaacaggaaaaactcttcttgccaaggctgtggctaactcaacatctgcgactttcttgcgtgttgttggtagtgaactcattcaaaagtaccttggggatggtcccaaactagtccgagaattgtttagggtggctgatgaactttctccctcaattgtctttattgatgagattgacgctgttggaacaaagaggtatgatgctcattca

SEQ ID NO: 1334 - DNA, 165 bp, Zea mays
ctgtgatgaaagttgagaaagcgcctttggaatcttatgctgacattggtggactggatgctcagattcaagaaattaaagaggcagttgagcttcccttgactcaccctgagctgtatgaagacattggtattaggcctcccaagggagtcatattatatggag

SEQ ID NO: 1335 - DNA, 248 bp, Zea mays
ctctgtcggacccgagtactatgtcagcatcctctcctttgtcgacaaggaccagctcgagccgggatgctccatcctcatgcacaataaggttctttctgtagttggtatattgcaagatgaagttgatcctatggtatctgtgatgaaagttgagaaagcacctttggaatcttatgctgacattggtggactagattcccagattcaagaaattaaagaggctgttgagcttcccttgactcatc

SEQ ID NO: 1336 - DNA, 256 bp, Zea mays
agagcgtgagattcaaagaactatgttggagctgctgaatcagctagatggttttgactcgcgtggagatgttaaagttattctagcaacaaaccgcattgaaagtcttgatcctgctttgcttcggccaggccgtatagaccggaagattgaattccctctcccagatattaaaactagaagacgcatcttccagattcacacatcaaaaatgacattagctgacgatgtgaacttggaagagtttgttatgacc

SEQ ID NO: 1337 - DNA, 237 bp, Zea mays
gaagacattgggatcaggccacccaagggagtcatattatatggcgaacctggaactggaaaaactctactcgccaaggctgttgccaattcaacatctgcgactttcttgcgtgttgtcggtagtgaacttattcaaaagtaccttggggatggtcccaagctagtcagagaattgtttagggtggctgatgaactttctccctcaatagtcttcattgatgagattgacgcagtt

SEQ ID NO: 1338 - DNA, 97 bp, Zea mays
acgtggctgatgaactttctccctcaatagtcttcattgatgagattgacgcagttggaacgaagaggtatgatgctcattcccgaggggagcgtga

SEQ ID NO: 1339 - DNA, 172 bp, Zea mays
  unsure (1)..(172): unsure at all n locations
ganaaactctactcgccaaggctgttgccaattcaacatctgcgactttcatgcgtgttgtcggtagtgaacttattcaaaagtaccttggggatggtcccaagctagtcagagaattgtttagggtggctgatgaactttctccctcaatagtcttcattgatgagattga

SEQ ID NO: 1340 - DNA, 303 bp, Zea mays
ggtatattgcaagatgaagttgatcctatggtatctgtgatgaaagttgagaaagcacctttggaatcttatgctgacattggtggactagattcccagattcaagaaattaaagaggctgttgagcttcccttgactcatcctgagttgtatgaagacattgggatcaggccacccaagggagtcatattatatggcgaacctggaactggaaaaactctactcgccaaggctgttgccaattcaacatctgcgactttcttgcgtgttgtcggtagtgaacttaattcaaagtaccttggg

SEQ ID NO: 1341 - DNA, 308 bp, Zea mays
agaaattaaagaggctgttgagcttcccttgactcatcctgagttgtatgaagacattgggatcaggccacccaagggagtcatattatatggcgaacctggaactggaaaaactctactcgccaaggctgttgccaattcaacatctgcgactttcttgcgtgttgtcggtagtgaacttattcaaaagtaccttggggatggtcccaagctagtcagagaattgtttagggtggctgatgaactttctccctcaatagtcttcattgatgagattgacgcagtggaacgaagaggtatgatgctca

SEQ ID NO: 1342 - DNA, 287 bp, Zea mays
  unsure (1)..(287): unsure at all n locations
gattgaattccctctcccagatattaaaactagaagacgcatcttccagattcacacatcaaaaatgacattagctgacgatgtgaacttggaagagtttgttatgaccaaagatgagttctcgggcgctgatattaaggccatctgcacggaggctggattgctcgccttaagagaacgtagaatgaaagtgacccatgcagatttcaagaaagcaaaggagaaggtgatgtacaagnagaaggaaggtgttccggatggtctctacatgtagtagacgtctcctg

SEQ ID NO: 1343 - DNA, 273 bp, Zea mays
gccacgcgtccgcggacggtggggattgaattccctctcccagatattaaaactagaagacgcatcttccagattcacacatcaaaaatgacattagctgacgatgtgaacttggaagagtttgttatgaccaaagatgagttctcgggcgctgatattaaggccatctgcacggaggctggattgctcgccttaagagaacgtagaatgaaagtgacccatgcagatttcaagaaagcaaaggagaaggtgatgtacaagaagaaggaaggt

SEQ ID NO: 1344 - DNA, 139 bp, Zea mays
ctggatgctcagattcaagaaattaaagaggcagttgagcttcccttgactcaccctgagctgtatgaagacattggtattaggcctcccaagggagtcatattatatggagaacctggaacaggaaaaactcttcttg

SEQ ID NO: 1345 - DNA, 290 bp, Zea mays
cgcagttggaacgaagaggtatgatgctcattcaggaggggagcgtgagattcaaagaactatgttggagctgctgaatcagctagatggttatcactcacgtggagatgttagggtcattctagcaactgaccgcattgaaagccttgatccagccttgcttcggccaggccgtatagaccggaggattgagtttcctctaccagatattaaaactagacgacgcatcttccagatacacacatcgaaaatgacattagctggtgatgtgaacttggaagagtttgtta

SEQ ID NO: 1346 - DNA, 291 bp, Zea mays
cgcgtgttgtcggtagtgaacttattcaaaagtaccttggggatggtcccaagctagtcagagaattgtttagggtggctgatgaactttctccctcaatagtcttcattgatgagattgacgcagttggaacgaagacgtatgatgctcattcaggaggggagcgtgagattcaaagaactatgttggagctgctgaatcagctagatggttttgactcacgtggagatgttaaagtcattctagcaacaaaccgcattgaaagtcttgatccagccttgcttcggccag

SEQ ID NO: 1347 - DNA, 121 bp, Zea mays
gcaagatgaagttgatcctatggtatctgtgatgaaagttgagaaagcgcctttggaatcttatgctgacattggtggactggatgctcagattcaagaaattaaagaggcagttgagctt

SEQ ID NO: 1348 - DNA, 263 bp, Zea mays
ttttgactcgcgtggagatgttaaagttattctagcaacaaaccgcattgaaagtcttgatcctgctttgcttcggccaggccgtatagaccggaagattgaattccctctcccagatattaaaactagaagacgcatcttccagattcacacatcaaaaatgacattagctgacgatgtgaacttggaagagtttgttatgaccaaagatgagttctcgggcgctgatattaaggccatctgcacggaggctggattgctcg

SEQ ID NO: 1349 - DNA, 291 bp, Zea mays
cgctgttggaacaaagaggtatgatgctcattcaggaggaaagcgtgagattcaaagaactatgttggagctgctgaatcagctagatggttttgactcgcgtggagatgttaaagttattctagcaacaaaccgcattgaaagtcttgatcctgctttgcttcggccaggccgtatagaccggaagattgaattccctctcccagatattaaaactagaagacgcatcttccagattcacacatcaaaaatgacattagctgacgatgtgaacttggaagagtttgttat

SEQ ID NO: 1350 - DNA, 277 bp, Zea mays
gacgatgtgaacttggaagagtttgttatgaccaaagatgagttctcgggcgctgatattaaggccatctgcacggaggctggattgctcgccttaagagaacgtagaatgaaagtgacccatgcagatttcaagaaagcaaaggagaaggtgatgtacaagaagaaggaaggtgttccggatggtctctacatgtagtagacgtctcctgccttgtcagaacaagttatcctcgtctctctcgtcatgggagatttgattgccacggcacttgttg

SEQ ID NO: 1351 - DNA, 276 bp, Zea mays
attgaattccctctcccagatattaaaactagaagacgcatcttccagattcacacatcaaaaatgacattagctgacgatgtgaacttggaagagtttgttatgaccaaagatgagttctcgggcgctgatattaaggccatctgcacggaggctggattgctcgccttaagagaacgtagaatgaaagtgacccatgcagatttcaagaaagcaaaggagaaggtgatgtacaagaagaaggaaggtgttccggatggtctctacatgtagtag

SEQ ID NO: 1352 - DNA, 333 bp, Zea mays
  unsure (1)..(333): unsure at all n locations
cgcatgttggaacgaagaggtatgatgctcattcaggaggggagcgtgagattcaaagaactatgttggagctgctgaatcagctagatggttttgactcacgtggagatgttaaagtcattctagcaacaaaccgcattgaaagtcttgatccagccttgcttcggccaggccgtatagaccggaagattgaatttcctctaccagatattanaactagacgacgcatcttccagatacacacatcgaaaatgacattagctgatgatgtgaacttggaagagtttgttatgaccanagacgagttttcgggtgctgatattaaggcaatct

SEQ ID NO: 1353 - DNA, 224 bp, Zea mays
catgcagatttcacgaaagcaaaggagaaggtgatgtacaagaagaaggaaggtgttccggatggtctctacatgtagtagacgtctcctgccttgtcagaacaagttatcctcgtctctctcgtcatgggagatttgattgccacggcacttgatgcacacctataagtggtctgagaacgtgtattatgctttgattggttcaagtaaaatttctcttggag

SEQ ID NO: 1354 - DNA, 266 bp, Zea mays
cctgaatcagctagatggttttgactcgcgtggagatgttaaagttattctagcaacaaaccgcattgaaagtcttgatcctgctttgcttcggccaggccgtatagaccggaagattgaattccctctcccagatattaaaactagaagacgcatcttccagattcacacatcaaaaatgacattagctgacgatgtgaacttggaagagtttgttatgaccaaagatgagttctcgggcgctgatattaaggccatctgcacgg

SEQ ID NO: 1355 - DNA, 258 bp, Zea mays
gctgaatcagctagatggtgttgactcgcgtggagatgttaaagttattctagcaacaaaccgcattgaaagtcttgatcctgctttgcttcggctaggccgtatagaccggcacattgaattccctctcccagatattacaacagaagacgcatcttccagattcacacatcaagaatgacatcagctgacgatgtgaacttagaagagtcggatatgaccaaagatgagttctcgggcgctgatattaaggccatc

SEQ ID NO: 1356 - DNA, 394 bp, Zea mays
  unsure (1)..(394): unsure at all n locations
cttgcgtgttgtcggtagtgaacttattcaaaagtaccttgnggatggtcccaagctagtcagagaattgtttanggtggctgatgaactttctccctcaatagtcttcattgatgagattgacgcagttggaacgaagaggtatgatgctcattcaggaggggagcgtgagattcaaagaactatgttggagctgctgaatcagctagatggttttgactcacgtggagatgttaaagtcattctagcaacaaaccgcattgaaagtcttgatccagccttgcttcggccaggccgtatagaccggaagattgaatttcctctaccagatattaaaactagacgacgcatcttccagatacacacatcgaaaatgacattagctgatgatgtg

SEQ ID NO: 1357 - DNA, 417 bp, Zea mays
cggacgcgtgggatgatgctcattcaggatgggagcgtgagattcaaagaactatgttggagctgctgaatcagctagatggttttgactcacgtggagatgttaaagtcattctagcaacaaaccgcattgaaagtcttgatccagccttgcttcggccaggccgtatagaccggaagattgaatttcctctaccagatattaaaactagacgacgcatcttccagatacacacatcgaaaatgacattagctgatgatgtgaacttggaagagtttgttatgaccaaagacgagttttcgggtgctgatattaaggcaatctgcacagaggctggattgcttgccttaagagaacgcagaatgaaggtgacccatgcagatttcaagaaagcaaaagagaaggtgatgtacaaga

SEQ ID NO: 1358 - DNA, 340 bp, Zea mays
ggaagattgaattccctctcccagatattaaaactagaagacgcatcttccagattcacgacatcaaaaatgacattagctgacgatgtgaacttggaagagtttgttatgaccaaagatgagttctcgggcgctgatattaaagccatctgcacggaggctggattgctcgccttaagagaacgtagaatgaaagtgacccatgcagatttcaagaaagcaaaggagaaggtgatgtacaagaagaaggaaggtgttccggatggtctctacatgtagtagacgtctcctgccttgtcagaacaagttatcctcgtctctctcgtcatgggagatttga

SEQ ID NO: 1359 - DNA, 327 bp, Zea mays
cagagtatgactcacgggttaaggcaatggaagtagatgagaaacctactgaggattacaatgacatcggcggacttgagaaacagattcaagagcttgtggaagcaatagtgttaccaatgacacacaaggaccgatttcaaaaattgggcattcgtccccccaaaggggttcttttgtatggaccccctgggaccgggaaaacgctcatggctcgtgcatgcgctgcacagactaatgcaacatttctgaaattggctggtccacaacttgtccagatgttcattggtgatggagctaagcttgttagagatgcttttcagcttg

SEQ ID NO: 1360 - DNA, 224 bp, Zea mays
ctactgaggattacaatgacatcggcggacttgagaaacagattcaagagcttgtggaagcaatagtgttaccaatgacacacaaggaccgatttcaaaaattgggcattcgtccccccaaaggggttcttttgtatggaccccctgggaccgggaaaacgctcatggctcgtgcatgcgctgcacagactaatgcaacatttctgaaattggctggtccacaa

SEQ ID NO: 1361 - DNA, 229 bp, Zea mays
ggcaatggaagtagatgagaaacctactgaggattacaatgacattggcggacttgagaaacagattcaagagcttgtggaagcaatagtgttaccaatgacacacaaggaccgatttcaaaaattgggcattcgtccccccaaaggggttcttttgtatggaccccctgggaccgggaaaacactcatggctcgtgcatgcgctgcacagactaatgcaacatttctg

SEQ ID NO: 1362 - DNA, 250 bp, Zea mays
gcttgtggaagcaatagtgttaccaatgacacacaaggaccgatttcaaaaattgggcattcgtccccccaaaggggttcttttgtatggaccccctgggaccgggaaaacactcatggctcgtgcatgcgctgcacagactaatgcaacatttctgaaattggctggtccacaacttgtccagatgttcattggtgatggagctaagcttgttagagatgcttttcagcttgctaaggagaaagccccg

SEQ ID NO: 1363 - DNA, 286 bp, Zea mays
gttaccaatgacacacaaggaccgatttcaaaaattgggcattcgtccccccaaaggggttcttttgtatggaccccctgggaccgggaaaacgctcatggctcgtgcatgcgctgcacagactaatgcaacatttctgaaattggctggtccacaacttgtccagatgttcattggtgatggagctaagcttgttagagatgcttttcagcttgctaaggagaaagccccgtgcatcatctttattgatgaaattgatgccattggaacaaagcgttttgacagt

SEQ ID NO: 1364 - DNA, 394 bp, Zea mays
gaccccgataagctgaagcctggcgatttagttggagttaacatagacagctacttgatactagatacattgccttcagagtatgactcacgggttaaggcattggaagtagatgagaaacctactgaggattacaatgacattggcggacttgagaaacagattcaagagcttgtggaagcaatagtgttaccaatgacacacaatgaccgatttcaaaaattgtgcattcgttcccccaaaggggttcttttgtatggaccccctgggaccgggaaaacgctcatggctcgtgcatgcgctgcacagactaatgcaacatttctgaaaatggctggtccacaacttgttcagatgttcattggtgatggagctaaggctgtagaaatgcttt

SEQ ID NO: 1365 - DNA, 420 bp, Zea mays
  unsure (1)..(420): unsure at all n locations
gcggacttgagaaacagattcaagagcttgtggaagcaatagtgttaccaatgacacacaaggaccgatttcaaaaattgggcattcgtccccccaaaggggttcttttgtatggaccccctgggaccgggaaaacgctcatggctcgtgcatgcgctgcacagactaatgcaacatttctgaaattggctggtccacaacttgtccagatgttcattggtgatggagctaagcttgttagagatgcttttcagcttgctaaggagaaagccccgtgcatcatctttattgatgaaattgatgccattggaacaaagcgttttgacagtgaaagttagtggtgatagaaaagtgccaanggcaatgttggaaatgctgnaccagctttgatggatttaacaccattanangnntaaaggt

SEQ ID NO: 1366 - DNA, 312 bp, Zea mays
ctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagag

SEQ ID NO: 1367 - DNA, 289 bp, Zea mays
accacacacagcctccggactgctccggacgcgcgcctcagatctactccaacacctccgcagcggcggcgcccgcgggtggaggagcaggagaggcggcgccctggtcgggaccgggaagagggagcggatagcgatacggaggatcgacaacctggcggccaggcaggtgaccttctccaagaggcggcggggcctgttcaagaaggccgaggagctctccatcctctgccacgccgaggtcggccttgtcgtcttctccgccaccggcaaactcttccacttcgcc

SEQ ID NO: 1368 - DNA, 224 bp, Zea mays
gtactctctccctcctaccacacacagcctccggactgctccggacgcgcgcctcagatctactccaacacctccgcagcggcggcgcccgcgggtggaggagcaggagaggcggcgccatggtcgggaccgggaagagggaacggatagcgatacggaggatcgacaacctggcggccaggcaggtgaccttctccaagaggcggcggggcctgttcaagaag

SEQ ID NO: 1369 - DNA, 244 bp, Zea mays
cccacgcgtccgcttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaagg

SEQ ID NO: 1370 - DNA, 236 bp, Zea mays
agcctccggactgctccggacgcgcgcctcagatctactccaacacctccgcagcggcggcgcccgcgaggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtc

SEQ ID NO: 1371 - DNA, 302 bp, Zea mays
aaagagtactctctccctcctaccacacacagcctccggactgctccggacgcgcgcctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttcc

SEQ ID NO: 1372 - DNA, 278 bp, Zea mays
aaagaggctagctctatggttgaagaggagattcaataccttcgagtggccatgggtcatgaaaatgaatcttttgaggacttcgtgaaagcacatgatgcatgccaagacgaccttatgttttttcctaccagcaatagctatggtttagctagtgtggctggaaatgctgataagatttctgctttgcaaaatgagtttgaaactgtgaagaagcgaatggatgatgaagctaagaaggcttctcggcttgagcagaagattaagcttctgacaca

SEQ ID NO: 1373 - DNA, 294 bp, Zea mays
ctcaaaaagagaaaaagaaaggaagcaagcgtcacaaaatggaggacctcttgtccctgaaattgatgattttgatgaagatgaactaaaagaggctagctctatggttgaagaggagattcaataccttcgagtggccatgggtcatgaaaatgaatcttttgaggacttcgtgaaagcacatgatgcatgccaagacgaccttatgttttttcctaccagcaatagctatggtttagctagtgtggctggaaatgctgataagatttctgctttgcaaaatgagtttgaaac

SEQ ID NO: 1374 - DNA, 266 bp, Zea mays
catgataatgcaaaatatcctcttgatgaaaaaactcagaaagagaaaaagaaaggaagcaagcgtcacaaaatggaggacctcttgtccctgaaattgatgattttgatgaagatgaactaaaagaggctagctctatggttgaagaggagattcaataccttcgagtggccatgggtcatgaaaatgaatcttttgaggacttcgtgaaagcacatgatgcatgccaagacgaccttatgttttttcctaccagcaatagctat

SEQ ID NO: 1375 - DNA, 257 bp, Zea mays
atttaaaaccagagtcattctctcgtcgtgtttgcaggcctttcagattgaaccgattacttcaacggtgtcatacatgattggtagggatgtgatggaggggagggggcaatgcaggtgcaggtgttgtactgtttcttagaattatccagcaacttcgatgggaggaattttgtttgagcttgtgggcccaatttgagaagttttacatatagagtaaaaaaaggtcctgctctcgtgttttcgtgtaaaactgg

SEQ ID NO: 1376 - DNA, 193 bp, Zea mays
ctcgagcgtgaagaaaggagcgtaacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttg

SEQ ID NO: 1377 - DNA, 289 bp, Zea mays
ctcgagccgtgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctg

SEQ ID NO: 1378 - DNA, 395 bp, Zea mays
cccacgcgtccgcttcttttgcagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgctttagaaaaaggagaaagcacttacagatcaaaacggtgtcctgcaaaagttcatggaggcatataaggagaaaaacatggctttgatgaacgcgc

SEQ ID NO: 1379 - DNA, 345 bp, Zea mays
cgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtggtctgcaaaa

SEQ ID NO: 1380 - DNA, 277 bp, Zea mays
aagtcgagcgcggcggccactgaaccccgtcccacacgcacccgtccgttccgcgcgatcagccgagcgatgtcgtcgtcggcgcccgcaccggccgccatggccgtggacgacgcggaggacgaccagctcgcctccatgtccacggaggagatcaccagggcctcccgtctcctcgacaacgagatccgcgtccacaaggacgagctgcagcggtcgaacctggagctggagtctatcaaggagaagaccaaggagaaccaggagaagattaagc

SEQ ID NO: 1381 - DNA, 313 bp, Zea mays
cagtcccatacgcacccgtccgttccgcgcgatcagccgagcgatgtcgtcgtcggcgcccgcaccggccgccatggccgtggacgacgcggaggacgaccagctcgcctccatgtccacggaggagatcatcagggcctcccgtctcctcgacaacgagatccgcgtccacaaggatgagctgcagcggtcgaacctggagctggagtctatcaaggagaagaccaaggagaaccaggagaagattaagctcaacaagcagctgccgtacctcgtcggcaacatcgtcgagattttggaaatgaaccctgag

SEQ ID NO: 1382 - DNA, 211 bp, Zea mays
tccagagcaagtcgatcgcggcggccacaaaacccagtcccatacgcacccgtccgttccgcgcgatcagccgagcgatgtcgtcgtcggcgcccgcaccggccgccagtggcctgggacgacgcgtaggacgaccaggctcggctccatgtccacggaggatatcgtcagggcctcccgtctcctcgacaacgagatgcgcgtccacaag

SEQ ID NO: 1383 - DNA, 285 bp, Zea mays
  unsure (1)..(285): unsure at all n locations
ggcggccactgaaccccgtcccacacgcacccgtccgttccgcgcgatcagccgagcgatgtcgtcgtcggcgcccgcaccggccgccatggccgtggacgacgcggaagacgaccagctcgcctccatgtccacggaggagatcaccagggcctcccgtctcctcgacaacgagatacagcgtcacaaagacgagctgcagcggtcgaacctggagctggagtctatcaaggagaagaccaaggagaaccaggangagattaagctcaacaagcagctgccgta

SEQ ID NO: 1384 - DNA, 270 bp, Zea mays
cgtcgagcgcggcggccactgaaccccgtcccacacgcacccgtccgttccgcgcgatcagccgagcgatgtcgtcgtcggcgcccgcaccggccgccatggccgtggacgacgcggaggacgaccagctcgcctccatgtccacggaggagatcaccagggcctcccgtctcctcgacaacgagatccgcgtccacaaggacgagctgcagcggtcgaacctggagctggagtctatcaaggagaagaccaaggagaaccaggagaaga

SEQ ID NO: 1385 - DNA, 311 bp, Zea mays
gcgcggcggccacaaaacccagtcccatacgcacccgtccgttccgcgcgatcagccgagcgatgtcgtcgtcggcgcccgcaccggccgccatggccgtggacgacgcggaggacgaccagctcgcctccatgtccacggaggagatcatcagggcctcccgtctcctcgacaacgagatccgcgtccacaaggatgagctgcagcggtcgaacctggagctggagtctatcaaggagaagaccaaggagaaccaggagaagattaagctcaacaagcagctgccgtacctcgtcggcaacatcgtcgag

SEQ ID NO: 1386 - DNA, 299 bp, Zea mays
acaaaacccagtcccatacgcacccgtccgttccgcgcgatcagccgagcgatgtcgtcgtcggcgcccgcaccggccgccatggccgtggacgacgcggaggacgaccagctcgcctccatgtccacggaggagatcaccagggcctcccgtctcctcgacaacgagatccgcgtccacaaggacgagctgcagcggtcgaacctggagctggagtctatcaaggagaagaccaaggagaaccaggagaagattaagctcaacaagcagctgccgtacctcgtcggcaacatcgtcga

SEQ ID NO: 1387 - DNA, 279 bp, Zea mays
gagcacaacgcacacgtccggccatcttcttcttgcacaagtcgagggccaccgctccgcatccgcatcttcttccagagcaagtcgagcgcggcggccacaaaacccagtcccatacgcacccgtccgttccgcgcgatcagccgagcgatgtcgtcgtcggcgcccgcaccggccgccatggccgtggacgacgcggaggacgaccagctcgcctccatgtccacggaggagatcaccagggcctcccgtctcctcgacaacgagatccgcgtccac

SEQ ID NO: 1388 - DNA, 367 bp, Zea mays
gcgcggcggccacaaaacccagtcccatacgcacccgtccgttccgcgcgatcagccgagcgatgtcgtcgtcggcgcccgcaccggccgccatggccgtggacgacgcggaggacgaccagctcgcctccatgtccacggaggagatcatcagggcctcccgtctcctcgacaacgagatccgcgtccacaaggatgagctgcagcggtcgaacctggagctggagtctatcaaggagaagaccaaggagaaccaggagaagattaagctcaacaagcagctgccgtacctcgtcggcaacatcgtcgagattttggaaatgaaccctgaagatgaggctgaagaagatggtgctaacatcgatct

SEQ ID NO: 1389 - DNA, 227 bp, Zea mays
gcacgagaggacttgaaaaagaaagaaagtgctgaaagagaagaacggggcaagaagtccctgagcatcaacgagttcttgaagccagctgaaggcgaaaggtactataaccctagtggccgtggccgtggtaggggccgtggggggttccgtggtggttacaacggcggttatcggggaccagctgctgctccagcgatcgaagaccaggctcagttccctgccct

SEQ ID NO: 1390 - DNA, 240 bp, Zea mays
gcacgagaggacttgaaaaagaaagaaagtgctgaaagagaagaacggggcaagaagtccctgagcatcaacgagttcttgaagccagctgaaggcgaaaggtactataaccctagtggccgtggccgtggtaggggccgtggggggttccgtggtggttacaacggcggttatcggggaccagctgctgctccagcgatcgaagaccaggctcagttccctgccctggcctaagcacag

SEQ ID NO: 1391 - DNA, 241 bp, Zea mays
cccacgcgtccgagaagaacggggcaagaagtccctgagcatcaacgagttcttgaagccagctgaaggcgacaggtactataaccctagtggccgtggccgtggtaggggccgtggggggttccgtggtggttacaacggcggttatcggggaccagctgctgctccatcgatcgaagaccaggctcagttccctgccctggcctaagcacagctcgtgttctcgctcaagattgtgtca

SEQ ID NO: 1392 - DNA, 262 bp, Zea mays
ggacttgaaaaagaaagaaagtgctgaaagagaagaacggggcaagaagtccctgagcatcaacgagttcttgaagccagctgaaggcgaaaggtactataaccctagtggccgtggccgtggtaggggccgtggggggttccgtggtggttacaacggcggttatcggggaccagctgctgctccatcgatcgaagaccaggctcagttccctgccctggcctaagcacagctcgtgttctcgctcaagattgtgtcactt

SEQ ID NO: 1393 - DNA, 453 bp, Zea mays
cggacgcgtgggtttttttttttaatatcagaaaatgttggatacacataatccggaaatgaagcttgggagcaacaacactaggactgactgacgcactccgcaaaagtgacacaatcttgagcgagaacacgagctgtgcttaggccagggcagggaactgagcctggtcttcgatcgctggagcagcagctggtccccgataaccgccgttgtaaccaccacggaaccccccacggcccctaccacggccacggccactagggttatagtacctttcgccttcagctggctttaagaactcgttgatgctcatggacttcttgccccgttcttctctttcagcactttctttctttttcaagtccttgtcagagcccagcttgataaacacttcatcgccatcctttttaactgacagttgttgcatggcctgtagctccttgtcaattt

SEQ ID NO: 1394 - DNA, 285 bp, Zea mays
ggagcaaggtggagcaggtcgtcggcgacgccgacatcaaggacagggcgcgggtgctcaaggacgaagcccaccggtgcgtcgccgaaggagggtcctcgaacgacaacttcaaaaagctcgtgaatctgctcagtgaatgatgagaaccgggagactgggagcatcgtgtccagtgtcctggcgttgtaaatgttggtgcacttagggcttgtttggtttgatggctaacttgtcatattttacctaacttttgtgtctaaagttagttcttcaattcgaacg

SEQ ID NO: 1395 - DNA, 313 bp, Zea mays
agcagtagagggcggcggctgcctcctcttcctacccgcgtccgagctcgcccccttcctcgccaccttgggaggcgacgagcatcaccaggacaccaggttgcctatattttcttccccttcttgaaaatggatcatagttctgacgaagatacagaaatcagtgattctgagattgatgattatgaaggaaaaatttatgcaagactgatgtcaggagatttaaaattaaataagaatggagaaaattacatttgtcccttctgtagcagcaagaagaagaattacagtaaaagtagcctggttcaacatg

SEQ ID NO: 1396 - DNA, 302 bp, Zea mays
  unsure (1)..(302): unsure at all n locations
ccccgacccatcagtagagggcggcggctgcctcctcttcctaaccgcgtacgagatgagnccccttcctcgccaccctgggangcgacgagcatcaccaggatcccaggttgcctatattttcttccccttcttgaaaatggatcatagttctgacgaagatacagtgatcagtgattctgagattgatgattatgaaggaaaaatttatgcaagactgatgtcaggagatttaaaattaaataagaatggagaaaattacatttgtcccttctgtagcagcaagaagaagaattacagtg

SEQ ID NO: 1397 - DNA, 251 bp, Zea mays
agaaaaggctgcatgttgtttcaaagcttcacgctatcttgcgtccattccttctaaggcgtatgaaggaggatgtggaacagatgcttccacgaaagaaagagataatcatatatgccaacatgactgagcaacagaagcaaatccagcatcacctgatcgaaaaaacatttgacaactacttgcacgaggaatcagatattatattgaaaagacctggcattagggcaaggttgcataatctaatgatt

SEQ ID NO: 1398 - DNA, 287 bp, Zea mays
caccacaccgcaccggcaccaccaccaaccgagcggctccaggctcctgctcaggaaggggagaagaggcgagccttccttaggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactg

SEQ ID NO: 1399 - DNA, 200 bp, Zea mays
ggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggagaccttctccaagcgccgcaacgggatcctcaagaaggcgcggg

SEQ ID NO: 1400 - DNA, 286 bp, Zea mays
caccgcgcggctccaggctcctgctcaggaaggggagaagacgcgcaccttccttgggaaatcgcaggaggagagaaggggaacaaagatggggcgcggcaagatcgagatcaagcggatcgagaactccaccaaccgccaggtgaccttctccaagcgccgcaacgggatcctcaagaaagcgcgggagatcagcgtgctctgcgacgccgagagtcgcgtcgtcgtcttctccagcgccggcccgctttacgaatactgcgtcccgaagacatcactatcaaaa

SEQ ID NO: 1401 - DNA, 279 bp, Zea mays
actcgacgaatcggctcgagacaccgcaccggcaccaacaccaaccgagcgagctccaggctcctgctcaagaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctcca

SEQ ID NO: 1402 - DNA, 318 bp, Zea mays
ccacgcgtccgagatggtgaagaaacttcccatggaacggcagcacaaattacttatttgcttgcaatcttgttctgcgttttgtgctctatgcaatgatgcgccagaagatcctgttgtcactctatgtggtcatgttttttgcaaccagtgcatactggagcaactcactggtgacgacagtgtatgcccagtgtctaattgcagagtccgactaaacacatcctcactcttctccagaggcactcttgaatgctctctgagtaaattagcctctgatttcaagtctgatgatacatgtatggaaatgatacatgc

SEQ ID NO: 1403 - DNA, 299 bp, Zea mays
gcacaaattacttatttgcttgcaatcttgttctgcgttttgtgctctatgcaatgatgcgccagaagatcctgttgtcactctatgtggtcatgttttttgcaaccagtgcatactggagcaactcactggtgacgacagtgtatgcccagtgtctaattgtagagtccgactaaacacatcctcactcttctccagaggcactcttgaatgctctctgagtaaattagcctctgatttcaagtctgatgatacatgtatggaaatgatacatgctgaaaagcgccctgggatggatt

SEQ ID NO: 1404 - DNA, 266 bp, Zea mays
gcgttttgtgctctatgcaatgatgcgccagaagatcctgttgtcactctatgtggtcatgttttttgcaaccagtgcatactggagcaactcactggtgacgacagtgtatgcccagtgtctaattgcagagtccgactaaacacatcctcactcttctccagaggcactcttgaatgctctctgagtaaattagcctctgatttcaagtctgatgatacatgtatggaaatgatacatgctgaaaagcgccctgggatggattc

SEQ ID NO: 1405 - DNA, 302 bp, Zea mays
ctcaagctcgaacgcgtcaaggactaccttctcatggaagaggagttcgttgccagccaggagcgcctgcgccccagcgaggataagacggaggaggaccgatccaaggtcgacgacctccgcggcactcccatgaacgtcggatcgctggaggagatcatcgacgagacccatgccatcgtctcctcgtccgtcggtcccgagtactacgtcgggatactttccttcgttgataaggaccagctcgagcctggatgtgcattctgatgcacaacaaggttctgtcagtggttggtattttg

SEQ ID NO: 1406 - DNA, 271 bp, Zea mays
gccttcgcctactcaagctcgaacgcgtcaaggactaccttctcatggaagacggattcgttgccagccaggagcgcctgctccccagcgaggataagacggaggatgaccgatccaaggtcgacgacctccgcggcactcccatgaacgtcggatcgctggaggagatcatcgacgagagccacgccatcgtctcctcgtccgtcggtcccgagtactacgtcgggatactttccttcgttgataaggaccagctccgagctggatgtgc

SEQ ID NO: 1407 - DNA, 318 bp, Zea mays
catcccttcagcatcgcttgacgcgataaaggaatggctggacacaactgacctcaagtactatgagagcaggctgaatctgaactggcgccctatcctgaaaactatagtcgatgatcctcagaagttcattgacgatggcggctgggagttcctgaacatggaggcgagtgactcagagactgaggacacagaggaatcagaccaaggctatgtgccttcagacgctgagcccgaatccgagtcagaagatgatgactctgacagtgagtccttggtggaatctgatgatgacgatgaggagtcagacgaggactc

SEQ ID NO: 1408 - DNA, 298 bp, Zea mays
ggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacat

SEQ ID NO: 1409 - DNA, 278 bp, Zea mays
atggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcagcgtgtgcatgtca

SEQ ID NO: 1410 - DNA, 247 bp, Zea mays
agagcatgagcaacaccaaggacagagccatgagcaacaacatcaacaacaattccagggtcatgacaagcagcaacaaccacaacagcctcagcaatatcagcagggccaggaaaaatcacaacagcaacaatgtcattgccaggagcagcaacagactacaaggtgcagctataactactatagcagtagctcaaatctaaaaaattgtcatgaattcctaaggcagcagtgcagccctttggta

SEQ ID NO: 1411 - DNA, 398 bp, Zea mays
  unsure (1)..(398): unsure at all n locations
caacaacaacaaccgcagcaccaccaccaacaacaacaacaacagcaccaacaacagcatcaatgtgaaggccaacaacaacatcaccaacaatcacaaggccatgtgcaacaacacgaacagagccatgagcaacaccaaggacagagccatgagcaacaacatcaacaacaattccagggtcatgacaagcagcaacaaccacaacagcctcagcaatatcagcagggccaggaaaaatcacaacagcaacaatgtcattgccaggagcagcaacagactacaaggtgcagctataactactatagcagtagctcaaatctaaaaaattgtcatgaattcctaaggcagcagtgcagccctttggtaatgccttttctncaatcacgtttgataca

SEQ ID NO: 1412 - DNA, 325 bp, Zea mays
cggacgcgtgggtggcgaactcttctctgtactagctttcttcttcttcctcctcttcctcctcccaaacagactggatttcatcaagataatcctgaaacatggagccaacaagcagacagagaaagaagagcaagaagaccggctcccagccgatacaaggtaggagtgagcagcgttagatcagttttcatcacaggatcgatatggtgacagtgagagaggagactcgcaaggggccatggacagagcaggaggacatgcaactgggctcaaccggacaggcaagagctgccggctgcgctgggtcaactacctccaccct

SEQ ID NO: 1413 - DNA, 377 bp, Zea mays
  unsure (1)..(377): unsure at all n locations
ctcttctctgtactagctttcttcttcttcctcctcttcctcctcccaaacagactggatttcatcaagataatcctgaaactggagccaacaagcagacagagaaagaagagcaagaagaccggctcccagccgatacaaggtaggagtgagcagcgttagatcagttttcatcacaggatcgatatggtgacagtgagagaggagactcgcaaggggccatggacagagcaagaggacctgcaactgggctcaaccggacaggcaagagctgccggctgcgctgggtcaactacctncaccctggcctcaagcgtgggcgcatgtctccccatgaagagcgactcatcctagagcttcacgctcggtggggaaac

SEQ ID NO: 1414 - DNA, 293 bp, Zea mays
ggattatctaccgattcttgccgcctgactctgaatggtcataccaacgagatgaattttgtagggctatctgttcatgatggatacataacttgtggctctgaaaccaatgaagagttttcttactacaaaactttccccatgccaataacttctcataggtttggttctattgacccgataactggacaagtgacaaatgaagacaaccagcaatttgtgtccagtgtttgctggagagggaagtcaaacatggtagtggctgccaactccagtggtagcatcaaagtgct

SEQ ID NO: 1415 - DNA, 232 bp, Zea mays
gcacgagggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccatcggaggacatgcctttcgtgatgatggaaggcttccacccgcagaacgccgctgctctgtacatgga

SEQ ID NO: 1416 - DNA, 354 bp, Zea mays
gagcgcacggagtggacggcgatgctacggccgcggctgagcgcgacgacgtggacgccggggcgtacgacgaggaggaggacgaagaagaggagctcgcagggtcccgcggcggcctcggggagaagaagcggcggctggcagcggatcaggtgcgcgcgctggagcggagcttcgaggtagacaacaagctggacccggagcgcaaggcccggatcgcgcgcgacctcagcctccacccgcgccaggtcgccgtctggtttcagaaccgccgcgcgcgctggaagaccaagcagatcgagcgcgacttcgccgcgctccgcgtgcgcaacgacgcactcagcgtcgagtgcg

SEQ ID NO: 1417 - DNA, 283 bp, Zea mays
tacgactagctcaagagaagtcggacctccaggatatgggcctgaagaaaaccaaggcagtggcatttcctgtaatacaagcagagagcaaatattgtttatgagccctacaaccatctcgagagaacttggtccaccaggatatttgcccagagaaaaccagcgcagtgacacttcatggaatacaagctgtgagtcgggactatttatgagtcctgcgaccacctcaatagaacatggtccaccaggatatgggcctggagaaaaccaggagaatgacagt

SEQ ID NO: 1418 - DNA, 291 bp, Zea mays
aggcagtggcacttcatggaatgcaagctgcgagttgggagtatttatgagtcctgtgaccacctcaagagaggacagtccgccaggatatgggcctcgagaaaaccaggagaatgacaatatgagatgcgagttgagaatgtttacaagtcctacaaccatctccagagaagttggcccaccaggatatgagcttactggaaaaaacaagggcaacggcgcttcatgtactacgaattaccagcagggagcgtttacgagtcctgaagccttcccaagagaagcctgtcc

SEQ ID NO: 1419 - DNA, 311 bp, Zea mays
gtggagtcctctgaggacgagccatgctcaggcgacacagatgcgacgacagacccagggcaggagcacagctcgcgcctggccgaccgcgagctcaaggagatgctgctgaagaagtacagcggctgcctgagccggctgcggtccgagttcctgaagaagaggaagaaagggaagctgcccaaggacgctcggtcggcgctgatggactggtggaacacgcagtaccgctggccgtaccgtacggaggaggataaggttaggctggcggacatgactgggctggacccgaagcaggtcgacaagtggtt

SEQ ID NO: 1420 - DNA, 303 bp, Zea mays
cggtgtgattacgagcatagctgggaggaagagcatgctgaagctggcagagaggatggtggcgagcttctgcggtggcgtgaccgcgtctgcggcgcatcagtggacgacgctgtcggggagcggacggcaggacgtccgcgttatgaccaggaagagcgtggacgacccaggcaggccgccgggcatcgtcctcaacgctgccacctccttctggctgcctgtcccgcccaagagggtcttcgacttcctccgcgacgagacctctcgcagcgagtgggacatcctctccaacggtggcgc

SEQ ID NO: 1421 - DNA, 230 bp, Zea mays
  unsure (1)..(230): unsure at all n locations
ggacggcntacggaccgccagtgcgagcgccttgccagtgtcatggccagcaacattccgaccagtgacatcggcgtgatcactagcacggcggggaggaagagcatgctgaagctggctgagaggatggtgacgagcttctgcgatggcgtgacggcctcagccgggcaccagtggacgacgctgtccggcagtggtgctgacgacgtccgtgtcatgaccaggaagag

SEQ ID NO: 1422 - DNA, 311 bp, Zea mays
tgcatttctcttcttagaatcaatgctgcaagcaactcatcccagaacgtggagctcatgctgcaggagagcagcacccaccccgacggcgggagctcgtggtgtttgcgtaccgtggacgtggacgccatccaagtgacaatgagcggcgaggacccttcctacatccctctcctcccgctgggcttcgccatcttcccggccgccaacccttcggctgcagcaaccagcgccgcaggctccggcgacggccaaagcagcccagcaggtaacgccgacgagcccgccagcggctgcctcctcaccgtggg

SEQ ID NO: 1423 - DNA, 294 bp, Zea mays
gccttcccaagagaagcctgtcctccaggattcgtaaaccctccctgctggtaattcgtaggatatgagcttactggaaaaaacaagggcaacggcgcttcatgtactacgaattaccagcagggagcgtttacgagtcctgaagccttcccaagagaagcctgtcctccaggatttgtgtctggagagaaccagggtaacgacactccatggtatatgagcagcaaacagatggcgtttacgagtcctacgaccaaccctagagtaggtccgcctaggtatggacaggaaaac

SEQ ID NO: 1424 - DNA, 318 bp, Zea mays
cccacgcgtccgcctccttccgttttccagccggcgccgcagggtgcatccgccctcactgcttggccccactggcggcccccacaacgctctctttggcggccacgcagcggtacctcgccggctcctcctcccagtggcggccggcatttgggacctgatctccggcggagctggcgccgccgccgctgcgtccctcgccgtccggcgaggtatgcagcttttccggcagggagatgtagctggctcgttggcagaatttgacaaggcgatcgagatggacccgcgacagaagcaatatctttggcaacggggcct

SEQ ID NO: 1425 - DNA, 311 bp, Zea mays
agacgagcgacgagaaggctggcgagcacgaggggaactcctccgcgccggagctgtcgccgtcggagaggcaggacctccagaacaaagtgtcggcactgatggcgctgctggatcaggtggaccggaagtacaggcactaccaccaccagatgcagatggtgatgtcgtccttcgacgcggtggccggcgccggcgcggcgaggccgtacacggcgctggcgctgcagaccatctcgcggcacttccggtcgctgcgcgacgctgtcggcgccaggtgcagtcgctgcggcggagctgggcgagaagga

SEQ ID NO: 1426 - DNA, 273 bp, Zea mays
ccacgcgtccgtgttctcgtgcatgattgctaaggccacagtcctagaggaggtgacatctggcattgcaggaagtaggaatggtgcgctgctgctgatgaaggctgagctacaggtgctctcacctctagtgcccatcagggaggtcacatttctcaggttttgcaagcagctggctgagggtgcatgggcagtagtggatgtgtccattgacggattggtgagagatcacaactctggaacagcatccaacgccggaaatatacggtgcag

SEQ ID NO: 1427 - DNA, 248 bp, Zea mays
gcggcgctgcgtcgccagctcgcagcgatttcaaggtgctggtgaatctggcttggccacatagatcttttttattgttgtcctcagaagacaggtttgctgagactgctttctgtctactgtaaattgatgaaattttggtgatcatatactatggaaaaaaagacagttcacgttctggctgagggtaatggtgagattgaaaatggtacgagctctagtcagaatcctgagacccttgagcatcc

SEQ ID NO: 1428 - DNA, 250 bp, Zea mays
gacgagttcatggaggcgtactgccgggtgctggagcggtataaggaggagctgtcgcggccattcgacgaggcagcgtccttcctcagcagcgtccggacgcagctcagctccctctgcggcgccgccgcctcgctctcagatgaaatggtagggtcgtcggaggaggacgaagcatgctcgggaggagacacggaggcgacggagccggggcagcaggagcacagctcccgcctggcggaccatgagc

SEQ ID NO: 1429 - DNA, 215 bp, Zea mays
ccgatgcttggcgttgaagaagggcgcggcgtaaaacggccctttttcacctcgcccgacgagctcctcgaggagagagtactacgacgagcagctgccggagaagaagcgccgcctcacgccagagcaggtatagctagctagtcgactcctcttgccacctagctaggcaacacgtagatgcatggcgtggcctgacctgagcgagcctgacg

SEQ ID NO: 1430 - DNA, 181 bp, Zea mays
ctagggttaacatttcgtcaggttaacaaatggtttgaaactaggcgtcattccgcaagggtagcttcttccaggaaaggcatcagtctagataagcatagcccccaaaatactaatagtcaagtgacagctagtatggaacctaaagaacctgaggggactgtggtggaagaatctaatg

SEQ ID NO: 1431 - DNA, 261 bp, Zea mays
agagaccgagctccctgaagttgatgcacatggtgtggaccaagagctgaagcaccatctcctgaagaaatacagtggctatctaagctcgctcaagcaagaactgtcaaagaagaagaagaaagggaagctccccaaggaggctcgccagcagctccttagctggtgggatcagcactacaaatggccttacccctcagagactcagaaggtggcactggctgagtctaccgggcttgacctgaagcagatcaacaactg

SEQ ID NO: 1432 - DNA, 177 bp, Zea mays
gcgcaccataatgaactgactacacaaaacactaaagaaagcttgcattctcttcatggttcagtagatgagaaacatggagatcttacttctaatggcagcaatatcaaagataggaaaggacattttggtccagtgattagtcagaagctacatgaacattttaagacacaacca

SEQ ID NO: 1433 - DNA, 233 bp, Zea mays
ctggcactcgtcattattcaagagatgctgttgccaagaatcagaaacgcccgggagaaaatactactgtgaataataatagcacaacctttgatgacatacaagtaatagaacccaatgttgggttgatagataaaccagctgcagatgtaaatgacatgatttctgaaaagttgatggtccaaatagatcttaacgaagacattgaagaagatatcccaccgagccaatat

SEQ ID NO: 1434 - DNA, 232 bp, Zea mays
tgcccatcgcgtctgagaaagggttgctcccataggaggccattcagaatattcctctactggtgttgagctgctatctacaagtggccgtacccttctagagacgtgtagtaagtattgcgctcgcagaatctacgggcctagaccagtagcatgatctatcaactggttcatcaaccagatcgaaatggttctggaagccatcggaggacatgcctttcgtgatgatggt

SEQ ID NO: 1435 - DNA, 119 bp, Zea mays
cccgagttggtttctatggtgagcgctttggcaagctcaataaaaaggagtatgtatttagagaaccacgggatgtacgtctcggtgatattatggagaagcttagtcatatatatgag

SEQ ID NO: 1436 - DNA, 246 bp, Zea mays
ggcgcggacgacgtcggcgtcggaggcgaggaggcgaactgcggcgcgacgaacgaggacgaggtgtcggacgacggctccctgcacgccgggcccggggagaagaagcggcggctgaacgtggagcaggtgcggacgctggagaagaacttcgagctcgggaacaagctggaggcggacgcaagctgcagctggcgcgcgcgctgggcctgcaaccgcgccaggtggcaatctggttccagaacc

SEQ ID NO: 1437 - DNA, 315 bp, Zea mays
cttgtgaagatatcttttgtgctacttgtggttcgaaaaatgctacattgggtaatgatatcattctctgtgatggagcttgtgacagagggttccaccagaactgtctaaatcctcctctgcgtactgaagatattcccatgggagatgaaggatggctctgcccagcatgtgattgcaagttagactgtatagatctaataaatgaactccagggcagtgacatctccattgaggacccttgggagaaagtttttccagaggcagctgctatggccaatagctctaagcaagatgaagcattgatcttccatc

SEQ ID NO: 1438 - DNA, 270 bp, Zea mays
  unsure (1)..(270): unsure at all n locations
agagaccggncttatcgtcttccgtggggtatggccacttggagtgctcctgccaccattgcttgaggatgctggtggtgtccccaggcagcttcccggccctccttttcctcaggatctcctcccgcacatcctctatnctcgacttgaaaccctgcttgagcnccatcttgagctcctgcctgancctctccatgagcgagcgctncnagtcggtgggcatgagcgggccgaagnccatcatgtcgtgcccgtcggagcccanatnna

SEQ ID NO: 1439 - DNA, 167 bp, Zea mays
ctgagaataatagtagcacaatctttgatggtatacaagtaatagaacccaattttggtttgatagataaaccagatgcagatacaaatgacatgatttctgaaaagttgatggtacaaattaatcttaacgaaagcattgaagaggatatcccaccgagccaatat

SEQ ID NO: 1440 - DNA, 280 bp, Zea mays
ggcggccccagcgcggcctccccgagcgctccgtcaacatcctccgctcatggctcttcgagcacttcctccacccgtacccgagcgacgccgataagcacctgttggcgaggcagaccgggctgtccaggaaccaggtctccaactggttcatcaacgcccgtgtccggctatggaagcccatgatcgaagagatgtatcagcaggagtgcagagagctcgacggctcctcggccggcggagggggccccgagtccgtcaacgacccctccggcgccga

SEQ ID NO: 1441 - DNA, 259 bp, Zea mays
ggagggcggacgcgggttgagtttcaggtgccttccccactggagccgactagggatagctatttcgtgaggtactgcaagcagaacgcggatggaacatgggccgtcgtcgacgtctcgctggacaccagctcagtcctcaagtgccggcgccggccgtcgggatgcctgatccaggaaatgcccaatggctactcaaaggtgacctgggtggaacacgtcgaggtggatgacaggtcggtaaacggcatctacaaac

SEQ ID NO: 1442 - DNA, 268 bp, Zea mays
cccacgcgtccgaacgtggtcctcaacggcggcgaccccgactacgtggcgctcctgccctctggcttcgccatcctgcccgacggcccgtcaggcagcagcaacatgcaaggcggtggcggtggcggcgtcggctcaggcgggtcgctcctgacggtggcgttccagatcttggtcgactccgtccccaccgccaagctctcgctggggtcggtggcgaccgtgaacagcctcatcgcccgcaccgtggagcgcatcaaggcggcgg

SEQ ID NO: 1443 - DNA, 274 bp, Zea mays
atattttctaatcaagataaaactggagcagaatttgctagatgcttactctggagatggatggaatgggcaaagccgagagaaaataaagccagagaaggaactgcaacgtgccaggaaacaaatcataaaatgcaaaattgctatacgtgatatcatccgccaacttgatttgtatacttctactgggagtgttgatgacccactaatgcctacagatcagtccaccaatcccgaacataccatgtgctcaacatgcaagtctcatgaatca

SEQ ID NO: 1444 - DNA, 258 bp, Zea mays
tgacattgtttctgagaaaccgatggtgcagaacaatcttaaccaaggggtggcagaaaagttgactagggatagaaatgacattgttcctgagaaacaggtggtgcagagcaatcttaaccaatgtaataatgaagatatcccgctttctggaacagaaattgagatggagtcttacgaacaagaatcatctgaaagcagtgatgaagagtggtccacacttagcacaccacgaaaaacaaaattacaaggcaacga

SEQ ID NO: 1445 - DNA, 262 bp, Zea mays
gcaatcaacggcgtgttcggctggctacaagccgacactgttgcagctgtttggattgttgcagctgcaaatccatagagagaaaaatactgtagaagccgcagccgcagccggattgcagccgcagcgaacaagctgcaagtcctctttcttttccgtctggcccacctgccaatctccataatggggccgtcgcattatcgcgccgcggtcggcacaatagtcatctcccgggcccgctggccagcgtgccacggcgtcg

SEQ ID NO: 1446 - DNA, 271 bp, Zea mays
cccaggtggtggttatggcactggcggatacggcagttacggtggagcaggtggtactggtggtgggagtacaggtgctcggggttcgagcaggtaccatccatatggaaaataagggcgtgttcggctggctgcaaccgacactgttgcagctgtttggactgctgcagctgcaatccatagagagaaaaatactgtagaagccgcagccgcagccggattgcagccgcagcaagccgcagcgaacaagctgtaactacaagttcaatca

SEQ ID NO: 1447 - DNA, 287 bp, Zea mays
gtcgttattacatgtgaccgtggcgacgacgacggtggctgcggcgcgcaggagacgtactgccggttgctggagcggtacaaggaggagctgtcgcggccgttcgacgaggcggcgtccttcctcagcagcgtcaggacgcagctcagctccctctgcggcggcgccgatcgctctccgatgaaatggtggagtcctctgaggacgagccatgctcaggcgacacagatgcgacgacagacccagggcaggagcacagctcgcgcctggccgaccgcgagctcaag

SEQ ID NO: 1448 - DNA, 144 bp, Zea mays
gtgcaggaaacgggattgcagctaaagcagattaacaactggttcatcaaccaacgcaaacggaactggcacagcaacccaacatcctcgggtgaaaagactaagaagaaaaggtgatattgatccagagcaatcttgacgatg

SEQ ID NO: 1449 - DNA, 308 bp, Zea mays
cggcggttcacggaggagcagatacggtcgctggagtccacgttccgcgcgcgccacggccacgccaagctggagccccgggagaaggcggaactggcgcgggagctgggcctgcagccgcggcaggtggccatctggttccagaacaagcgcgcccgctggcgctccaagcagctcgagcacgactacgccgtgctccgcgccaagttcgacgacctccacgcccgcgtcgagtccctcaggcgcgacaagctcgccctctccacgcagctttttgcttggtgcgcgcgcgtgcatgaccagttgaa

SEQ ID NO: 1450 - DNA, 279 bp, Zea mays
caggttatggtcctggagaaaactttattcaggtcagttcaaggattactagctgtgagcagagtgtgataatggctcctagcgctatcgcaagaggagttggtccaccaggatatacgcctggagaacaccagggcaatggggctccatggaatacaagctatgagcgaagaccgtttacgagtcctacgactagctcaagagaagtcggacctccaggatatgggcctgaagaaaaccaaggcagtggcatttcctgtaatacaagcagagagcaat

SEQ ID NO: 1451 - DNA, 201 bp, Zea mays
agaggagctgacccggccgctccgggaggcggaggagttcctgacgacagtggaggcgcactcaactccattactaacaccgggccaaccatgggagctttcatctcttcagctgcagataaaactggagtcgtcgatatgtccgacgatgaacaagaagaaggcagcggcatggaggcagaagcagccctgggcatcgat

SEQ ID NO: 1452 - DNA, 302 bp, Zea mays
ggcgtgatcactagcacggaggggaggaagagcatgctgaagctggctgagaggatggtgacgagcttctgcggtggcgtgacggcctcagccgcgcaccagtggacgacgctgtccggcagtggtgctgacgacgtccgtgtcatgaccaggaagagcgtcgacgaccctggcaggccgccgggcatagtcctcaatgctgccacctctttctggctccctatcacacccaagcgtgtcttcgacttcctccgtgacgaaagctctcgcagcgagtgggacatcctctccaatggcggcgt

SEQ ID NO: 1453 - DNA, 294 bp, Zea mays
cggctcgagccaatggctctaagcaagatgaagcatttgatcttccatctgatgattcgactgacaatgattttgaccccaatatgcctgaagagcatgtggctagtaaggaagaaggatcttctgaagaggaagaggatgatgacggaggatcagactctgacgtctctgacttcttaacctgttctgatgatttggaacctttgatagataaaaagaaggttgatgacctgggattaccttctgaagattcagaggatgatgactatgatccagcaggtcctgattcggata

SEQ ID NO: 1454 - DNA, 171 bp, Zea mays
atgatgcattgttttcatcgatgttgattttattgtaagatggaatgttgtaccaaacctgaacagatcactttgttgtgattcagtgtgcggctatggcctatggatttgtacttgttggactcaaaaaaaaaaaaaaaaataaaaaaaattgtaatacgataaaaatta

SEQ ID NO: 1455 - DNA, 228 bp, Zea mays
atcctcccggacggccactgccagtcaccaaacactgcacatcagggttcaccaagctgcagcggtagcagcagcagcagcatcacggggtctctagtcacggtggcattccagatcctggtgaacaacctgcccaccgcgaagctcaccgtggagtcggtggagaccgtcagcaagctgctatcatgaaccatccagaagatcaagtctgcgctccaggccagcatc

SEQ ID NO: 1456 - DNA, 247 bp, Zea mays
ctagcatataggagcaacgagcaaggacctgagaaggtaggcgcattctgcaggatgaaatgaagtaatagaataggtaaattaggcctgaatagatagaacatgtcaagtgtcgcctcagaatgactagactaaactggtcaccattgatttacagcttgttcgctgcggcttgtctgcggctgaatccggctgcggctggggcttatagagtatgtctccccctatggattgaagctgcagcagt

SEQ ID NO: 1457 - DNA, 274 bp, Zea mays
ctctgcagttgctcttttccagaacaaggtacaccaattctgttggtatttggatttggaggattacctgtgctctgatgacttgctgtcatattagtagtttgtattccgtatcaaataatggaaaccatatttactgaaactcacatgcgtacttctattctagatttcaaactggttcatcaatgcccgtgtccggctgtggaagccaatgatcgaagacatgtacaaagaagagcttggtgaagcggagtagactccaatcttctccgac

SEQ ID NO: 1458 - DNA, 191 bp, Zea mays
gcagtcatggcttgttgggagctcgaacaaactttacaaagccttacaggtgcatctcctggtgagggcactggggcaactatgtctgacgatgaagacaatcaggtggacagtgagagcaacatgtttgatggaaatgaggggtcagatggaatgggatttggcccattaatgttgactgagggtgagag

SEQ ID NO: 1459 - DNA, 182 bp, Zea mays
  unsure (1)..(182): unsure at all n locations
aagtgagggagtatcttttgatccacaagagtctggtgccaatacagcagctgagctttcaactgctgagaaacaagagctccagaataagatggcgatgactatgancaatgtggatgaggtggatcggaagtacaacactattatcatcggatgcaacttgtaatgtcatcgtttgatat

SEQ ID NO: 1460 - DNA, 294 bp, Zea mays
ggagggcctcaagctgcacgactaccgcgccatcatccggagccccatggatctcggcaccgtcaagcagaacctcaccgccggccggtacccctcgcacgaggcgttcgctggcgacgtccggctcaccttcaacaacgcgctgcggtactccccgcccgaccaccacgtgcacaggtacgccggcaacctcctcgcctcgttcgaggggatgtacaaggaggccgtctcgtggttcgagcagcagcgccagcagctcgagccaccaatgcagcccgatttgccgccgccgcc

SEQ ID NO: 1461 - DNA, 292 bp, Zea mays
cctggccatactcatgtcccctgatacagtttcagctaatgactcgtcagtcataacacaggagggcaagcgaagatgctgaagctggcacggcggatgacggagaacttctgcgccggggtcagcgcgtcatctgcacgtgaatggagtaagctggacggcgctgcaggcagcatcggggaggatatgcgggtcatggcacggaaaagcgtggacgagcctggggagccgccggccgtggtcctaagcgcaccacatcggtgtgggtcccctggctccgagaaactcttca

SEQ ID NO: 1462 - DNA, 111 bp, Zea mays
atcctgaagttacccagaaattgaaggtgcatacttccgtcctgtgctactactgccattggagcgaagtatgatcctgaagttacccagaaattgaaggtgcattttgag

SEQ ID NO: 1463 - DNA, 269 bp, Zea mays
gactgcgctaccgctgaggcggtcgtcgctctcgggcgccgagcagcagtggaggaagacaaggctcatctccctcatggatgacgtctgcaggcgatacaagcagtactaccagcagctgcaatccgtgatctcctcgttcgagactgttgcagggctgagcaacgcggcccccttcgctttcatggctcttcggacgatgtcgaagcacttcaagtgtctgaaggggatggtgatgagccagctacggaacacgagcaaggtcatcg

SEQ ID NO: 1464 - DNA, 286 bp, Zea mays
agatacacctagattacaagccgccaagcggaaattagcagcaacattacaggagaactacaagccatgcatagacgctacatcgaccgacccaccccttggcaatcagcaacaaaaattccacaacaatgtccttgcaccgcaacactgcaatatactcccacggtccgacgattggataggaccccacagtcgtccatggaagtgtgtaatccatgaaccgaggcgatacatgccgtcagccatgaacggcccgtccatgtacagagcagcggcgttctgcggg

SEQ ID NO: 1465 - DNA, 339 bp, Zea mays
  unsure (1)..(339): unsure at all n locations
agcaggtgcagctgctggagcggacttcgaggaagagaacaagctggagcctgagcgcaagaccgagctggctcgccgcctgnggatggcgccccgcaggtggccgtgtggttccagaaccgccgcgcgcgttggaagacaaagcagctcgagaccgactatgaccgcctcaaggctgcctacaacgcgctcgtcgctgaccaccagggcctcctggccgacaacgatagccatcgggcacaggtgatctgcctaacagagcagctgctaggctaggagacatcgctgtcggcaaccattgctaccctagaggtcgactagcccagacgacacaccaca

SEQ ID NO: 1466 - DNA, 285 bp, Zea mays
gttctcttgaagaaagtggtgaagctcggcgccttagaaaatcattcgaggaaatggctgatgtaagaagcaaggatctgttgaaagattcttgcctccctgttactgcattggaggcggcccctgatggttcctctgataatatgtggtcttgggcagaggtgaaacatctctctaaatgtctagtccaggcccttgatgctggtctggaacacgccctcttggattctgtagtgactgtagacaggtatgcagctgctgagggtttctataaactagctatgg

SEQ ID NO: 1467 - DNA, 351 bp, Zea mays
cagggcaataccacttcgtggatttcgacctgccagcagagaatgcttgcaggaatccagagaactggtggctcaaggagtatggacttggaagcctttccaccgggatacggacctggtggtgcttcagggagtgccataagcccccaagctcggtctgcagagaatgtagaattttcggacgaggctagaaaaaaggctatacagcgggagctgagacggcggcagaagttcaggtgaaggcaatatatccagtcttcaagacaagacaatatatccagtcttgatggctgaatgagtgggcgaccttagttgccatcaagcataacccttgttgtatcagctgcttat

SEQ ID NO: 1468 - DNA, 276 bp, Zea mays
gtgctggtaaccttaagatttctaccaactttgtcttctgcacatgaagtctctgccatcaagaagttaatgcgattctgcagctgcaatccatagagacaaaatactgtagaagccgcagcgcaccggattaaagccgcagcaaaccgcagcgaacaattatcttgcttctgatgaaaagtgtgtcgataacagtagcatcgtgtaacattattgtgaccacgcatttcagaaatgatgaagtgatagcttcacttccatttcttctgaaaagcg

SEQ ID NO: 1469 - DNA, 273 bp, Zea mays
aaattatcttctgcaaagggccctgcaaaagggcatgtcatgagaaatgtttggaacctcccttaaacaaaagcgtacttccaacaagtagccatgggtggctttgcaaattctgtttgtgcaaggtgaggattttagaaactattaatgcacatctagggacgagttttacagtgaagtgccactttgaagatatattcaaggaaactactgaactaatagactctgaggatgcactagatgaagattggcttctgagtattcaggtgatga

SEQ ID NO: 1470 - DNA, 222 bp, Zea mays
attcaactagccaataaacttttcacacaagctgaactctaccagttttgtgcaagcattcaggaactcataattcctgtgtatagaagcagaagggcttatggacagctggccaaatgccacacatcgctcacaaacatctatgagtcaattcttgaacaggaggctagccctataccattcattgatgccacatactaccgagtgggtttctatggtgag

SEQ ID NO: 1471 - DNA, 380 bp, Zea mays
tcgacttcctccgtgacgaaagctctcgcagcgagtgggacatcctctccaatggcggcattgttcaagagatggctcacatcgccaacggccgcgaccatggaaactgcgtctcgcttcttcgtgtcaatagcacgaactcgaaccacagcagcatgctgatcctccaggagagctgcaccgacatgtcgggctcgtacgtcatctacgcccggtggatgtggtcgccatgaacgtggtcctcaacggcggcgaccctgactacgtggcgctcctgccctccggcttcgcgatcctgcccgacggcccatcgtcagggagcagcagcatgctgcaaggcgacggcggcgtcggctcaggtgggtcgctcctgacggtgg

SEQ ID NO: 1472 - DNA, 261 bp, Zea mays
gcttgttcgctgcggcttgctgcggctgcaatccggctgcggcttctacaggattcatctctctatggattgcagctgcagcaatccaaacagctgcaacagtgtcggcttgcagccagccgaacacgcccataagcgatagcgtgcatcccggctggtacatgtaaagtctgtaactgtcagtttggcaatctcttcttgatctactcccctgagttttacaaccttttgccgattctttactgggagttgcaattccac

SEQ ID NO: 1473 - DNA, 266 bp, Zea mays
gcgagtgaagcgtcgggggtgcaaatggctactgcccataccgccgaagatagcaaccatgtcccctggagtggcacacgttagcctgacaaaaaggcggggaaaaaaaaaggagaggaactacggtgtgtttcggttgtgggcttgttcgctgcggctttaatccgactgcggctgcggcttctacatcattttctctctcgggattgcagctgcaacagtattttgcagctgcaacagtggtttttgtagtgcagccgaacgcg

SEQ ID NO: 1474 - DNA, 251 bp, Zea mays
gatcagacggtatgggctttggccccctgatactaacagagggtgaacggtccttagttgagcgtgtacggaaggagctgaagaacgagcttaagcagggttacaaggaaaagcttgtcgatatcagggaagagatcatgcgcaaacgcagggctgggaagcttcctggagataccgcatctgtacttaaagcttggtggcaagctcattccaagtggccgtacccaactgaagacgacaaggccagactg

SEQ ID NO: 1475 - DNA, 281 bp, Zea mays
cttacgtcttcccccagctagctagctatctaccttggtggtggcgattgatatatagattaaacatggcgcctcaaagcctggatctcgggctgagtctcggcctgggcgtggcggcattccagcccagcttctgccacccggccggcagcggcagcggcgacgaatggcgacgacgggggcgcttgcaagaagctgcggctgtccaaggaccaggccgccgtgctcgaggagtgcttcaaaacgcaccacaccctcactccggcgcgtctcctcttcat

SEQ ID NO: 1476 - DNA, 260 bp, Zea mays
gtggcgtaacacttaacaagtttaaagacctataaataagttcgtggacctaagtggcacctcttgataagtttatggtccgttgatgcatttaactcatattttaatggtgccttggacttaactctaatattgtgttatgttatatcatttggaataaagtccttccattcatttttttgtgtgtccccaaactagagatgaattgattagttacaggaactaagggttccaagaaaaatgttgcatccttttcttta

SEQ ID NO: 1477 - DNA, 310 bp, Zea mays
aggcatactccgaggcatccttctcctttccctctccttccccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaagagccacggccatggccacggccagcaccaccatcatcaccaccaccaacacccgtgggcatcctccctcagcgccgtcgtagc

SEQ ID NO: 1478 - DNA, 255 bp, Zea mays
cttctctctaatgatagcatagggagagaaggcatactccgaggcatccttctcctttccctctccttccccaaacccttttcccctttccctcgccccaagaacttcagctcatctccaggcgccccttttgcgcttgcgcaggaggagctcacggggacagtgggcggagagctcgatcgctgcagcagtagttcactggaggtccgcccactcccatggaggagatcacccaacactttggagttggcgcaa

SEQ ID NO: 1479 - DNA, 251 bp, Zea mays
tccttctcctttccctctccttccccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaacagccacggccatggccacggccagcaccaccatcatcacca

SEQ ID NO: 1480 - DNA, 228 bp, Zea mays
cccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaagagccacggccatggccacggccagcaccaccatcatcacca

SEQ ID NO: 1481 - DNA, 305 bp, Zea mays
gatggagacaagcaaatgcttgctaaacagacgggtttaacacggaaccaggtatccaactggtttattaatgcaagggttcgtctttggaaaccaatggtggaagagatccacaaccttgagatgaggcaggtgcacaaacaccctgttctcgacaagggccagcacgtgctgcatcaccaaacccagcattcgttcgagagcagtggaaagccttctgacccttccgactctcagcttggccaaagcagcagcatcacgaggaaccacaacatccctgcgtcccagggatttgccgatgagct

SEQ ID NO: 1482 - DNA, 281 bp, Zea mays
gttggcctcaaggaggacgacctcgagcggatcgtccagcgagcgataataagctagggcgtgttcggctggctacaaaccgacactgttgcagctgtttggattgctgcagctgcaatccatagagagaaaaatactgtagaagccgcagccgcagccggattgcagccgcagcaagccgcagcgaacaagctgctagctaggagtagtcgtcaactcgtcatgtagtaccacacagactcagttttcgcacgtgtgccaagacaaaactacaaaaggac

SEQ ID NO: 1483 - DNA, 264 bp, Zea mays
gtttgcctcaaggaggacgacctcgagcggatcgtccagcgagcgataataagctagggcgtgttcggctggctacaagacgacactgttgcagctgtttggattgctgcagctgcaatccatagagagaaaaatactgtagaagccgcagccgcagccggattgcagccgcagcaagccgcagcgaacaagctgctagctaggagtagtcgtcaactcgtcatgtagtaccacacagactcagttttagtacgtgtgccaaga

SEQ ID NO: 1484 - DNA, 174 bp, Zea mays
actacatatccagtcttgatggctgaatgacgaccctagttatcgagacgcaaaaccttttgttgtatgtgttccttttacagacttccttggcttgtcatgaatttctaatgtgaacttgtgctgtgaacttgttgcaaaacctcttgaacctgaagcattcaacatgctgtg

SEQ ID NO: 1485 - DNA, 282 bp, Zea mays
caagttcaggtgatggccgtgatgcgaacttctgatcctgcttatcgaattttgactacggattactactttttaagactacatatccagtcttgatggctgaatgacgaccctagttatcgagacgcaaaaccttttgttgtatgtgttccttttacagacttccttggcttgtcatgaatttctaatgtgaacttgtgctgtgaacttgttgcaaaacctcttgaacctgaagcattcaacatgctgtgaacttgtgcagctgctcttcttctgcatgag

SEQ ID NO: 1486 - DNA, 71 bp, Zea mays
gtgaacttgtgctgtgaacttgttgcaaaacctcttgaacctgaagcattcaacatgatgtgagcttgtgc

SEQ ID NO: 1487 - DNA, 212 bp, Zea mays
gttcaggtgatggccgtgatgcgaacttctgatcctgcttatcgaattttgactacggattactactttttaagactacatatccagtcttgatggctgaatgacgaccctagttatcgagacgcaaaaccttttgttgtatgtgttccttttacagacttccttggcttgtcatgaatttctaatgtgaacttgtgctgtgaacttgttgc

SEQ ID NO: 1488 - DNA, 315 bp, Zea mays
gcagggagtgcgctcgacggccgccgccattagtgatttagtgttgaagagggagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagcgcgtcgctcctcctcgtctttcccgcagcagcagcagcagcaccaccaccaccagtacgccaggcacggcgccgagatgtcggcggcggaggccg

SEQ ID NO: 1489 - DNA, 224 bp, Zea mays
tcgactgagcgtagtaagctcggccgaccagaggcagggagtgcgctcgacggccgccgccattagtgatttagtgttgagagagggagagaatctaaagtgaccggacgctgtccttccttgctgatcggcgacacggtccatgcctccctcgctcgctagggttccttttcgtccatggatcagagcttcgggaatctcggggccggagctgggagcagcag

SEQ ID NO: 1490 - DNA, 307 bp, Zea mays
gtggagctggctgtgacggccatggaggagctggttcggatggcgcactaggacgagccgctgtggaacgcgccggcagcgggcacgacgggtctgctgagacgctgaacgaggaggagtacgcgcgcatgttcgtccctgctggagggctcgggctaaaaaagcagtacgggttcaagtcggaggcgtcgcgcgacagctccgtcgtcatcatgacccatgccagcctcgtcgagatcctcatggacgtgaatcagtatgcgacggtgttctcgagcatcgtgtcgagagctgcgacgctggaggt

SEQ ID NO: 1491 - DNA, 224 bp, Zea mays
tgtggagctggctgtgacggccatggaggagctggttcggatggcgcagctggacgagccgctgtggaacgcgccggcaggcgggcacgacgggtctgctgagacgctgaacgaggaggagtacgcgcgcatgttcgtccctgctggagggctcgggctaaaaaagcagtacgggttcaagtcggaggcgtcgcgcgacagctccgtcgtcatcatgacccatg

SEQ ID NO: 1492 - DNA, 287 bp, Zea mays
tgggaaactccctggcgacactgcttctaccttaaaagcatggtggcaggctcattctaagtggccgtacccaaccgaggaagacaaggctcgactggtgcaggaaacagggctacaactgaagcagatcaataactggtttatcaaccagcgtaactggaactggcacaacaattcggcgtcatcctcgtcggacaaaagcaagagaaaaaggaacactgcaggtgatgggaacgcagaaccagcctggtagggcatggtcggggaacgaatttatgtaaataatg

SEQ ID NO: 1493 - DNA, 304 bp, Zea mays
cgaggaagacaaggctcgactggtgcaggaaacagggctacaactgaagcagatcaataactggtttatcaaccagcgtaacggaactggcacaacaattcggcgtcatcctcgtcggacaaaagcaagagaaaaaggaacactgcaggtgatgggaacgcagaaccagcctggtagggcatggtcggggaacgaagtttatgtaaataatgcttctactgtgaagagttccatcatatttgttgctccagaaaagaccctcagaccggtgtttcctgaacccatattcatacaaagacatcag

SEQ ID NO: 1494 - DNA, 165 bp, Zea mays
cgcggaagcgtaagagctggcgaaactccctggcgacactgcttctaccttaaaagctggtggcaagctcattctaagtggccgtacccaaccgaggaagacaaggctcgactggtgcaggaaacagggctacaactgaagcagatcaataactggtttatcaac

SEQ ID NO: 1495 - DNA, 331 bp, Zea mays
  unsure (1)..(331): unsure at all n locations
gagctngggaaactccctgacgacactgcttctaccttaaaagcatggtggcaggctcattctaagtggccgtacccaaccgaggaagacaaggctcgactggtgcaggaaacagggctacaactgaagcagatcaataactggtttatcaaccagcgtaacgaaactggacaacaattcggcgtcatcctcgtcggacaaaagcaagagaanaaggaacactgcaggtgatgggaacgcagaaccagcctggtagggcatggtcggggaacgaatttatgtacataatgcttctactgtgaagagttccatcatatttgttgctccagaa

SEQ ID NO: 1496 - DNA, 254 bp, Zea mays
ataccttaaaagcatggtggcaggctcattctaagtggccgtacacaaccgaggaagacaaggctcgactggtgcaggaaacagggctacaactgaagcagatcaataactggtttatcaaccagcgtaactggaactggcacaacaattcggcgtcatcctcgtcggacaaaagcaagagaaaaaggaacactgcaggtgatgggaacgcagaaccagcctggtagggcatggtcggggaacgagtttatgta

SEQ ID NO: 1497 - DNA, 296 bp, Zea mays
cggacgcgtggttattggaaggctttccttcctgtggtctacaacatatttaatcttcatggtgcaacactaatggcaagggagaatgaccgcttctacaatcaaattgcttttcatcttttgcggcttgctgtttttcgaaatgattctattaggaaaagagctgttgttgggttgcagattctcgttaggaacgcattcaactatttcaagaacactacaaggttgagagtcatgttgacaattactttgtcagagttgttgtctgatgtgcaagtgactcaaatgaaatccga

SEQ ID NO: 1498 - DNA, 252 bp, Zea mays
  unsure (1)..(252): unsure at all n locations
ancncggcggcgcggcaggtcacgttctccaagcgccgccgcggcctcttcaagaaggctgaggagctctccgtgctgtgcgatgccgacgtngcgctcatcgtcttctcctccacgggaaagctctcccagttcgcnagctccagtatgaatgagatcattgacaagtacagcacacattctaaaaacctggggaaagcagaacagccttcacttgacttgaattagaacatagcaaatatgcaaatttga

SEQ ID NO: 1499 - DNA, 293 bp, Zea mays
aattttcacgaggaaaatctcttttgcgtttttgtttctcgaggttggagcgccgctcgagattgtcggtcggctttctgccctcgctgatgacgtcgaaacgaattcagacggcagacaagaagaacaaccagcagacccagagctcgatcagttcatggagatctactgtcacatgttggtaaggtacagacaggagctcacaaggccaatccaggaagcggacgaattcttcaaaagcatggaggcccagatcgactcattttcattagatgacaatggctatgaggaag

SEQ ID NO: 1500 - DNA, 296 bp, Zea mays
gcgccgctcgagattgtcggtcggctttctgccctcgctgatgacgtcgaaacgaattcagacggcagacaagaagaacaaccagcagacccagagctcgatcagttcatggagatctactgtcacatgttggtaaggtacagacaggagctcacaaggccaatccaggaagcggacgaattcttcaaaagcatggaggcccagatcgactcattttcattagatgacaatggctatgaagaaggaggcggttcctccgacgaagatgagcaagaaaccgtcgacttgggcggcct

SEQ ID NO: 1501 - DNA, 116 bp, Zea mays
atcctgtaatggaggatgaggacttgggtagcaggagggaaaggattttttctttatctactggtactgtacgtgcacgtgtttttgaccgttttcttttcgatacaccattcaca

SEQ ID NO: 1502 - DNA, 163 bp, Zea mays
cacactttacatataattccagattctagacaagtcaatgctgatgagttgcagcctggcgtctgctatttacagatcactgctgttgatcctgtaatggaggatgaggacttgggtagcaggagggacaggatttgctctttatctactggtactgtacgtg

SEQ ID NO: 1503 - DNA, 245 bp, Zea mays
gctggacgtggacaactttgagcttttggcgcggatttgcggagtggagggagcgtatccgacgttcgtgctgttcaagaaatgcgcgcaggtgggcaaggtcgttggcctcaaggaggacgacctcgagcggatcgtccagcgagcgataataagctagggcgtgttcggctggctacaagccgacactgttgcagctgtttggattgctgcagctgcaatccatagagagaaaaatactgtaa

SEQ ID NO: 1504 - DNA, 300 bp, Zea mays
caatccgtgtgcatttcagattgataggggaagaagaccaggaattccacacccaacttgtcaatgggttccagtcactcaccgctgagctatctcactatatccctgctatactctccgagctatgatagaactgtagcaagccagaaattaggtagcatgtgaatggttgttcattcattcagttgcaggttcccaccaaatgtccatatttccagctttggttgtatagttctaggaaccggaaattaactagtcttcgaagttctgtaccgtattgcagaaccgattcctgatttt

SEQ ID NO: 1505 - DNA, 367 bp, Zea mays
accaccaccttcctgctcctccccttcatcttcaccacaaccccttcctcccctcctgtcagtgcccctccctgcaagacttccgaggtatggcgccaatgctgcggaagcgcccgacgatgtactgcggcgcggacgacgtcggcgtcggaggcgaggaggcgagctgcggcgcgacgaacgaggacgaggtgtcggacgacggctccctgcaggccgtcgggcccggggagaagaagcggcggctgaacgtggagcaggtgcggacgctggagaagaacttcgagctcgggaacaagctggaggcggagcgcaagctgcagctggcgcgcgcgctgggcctgcagccgctgcaggtggccatctg

SEQ ID NO: 1506 - DNA, 436 bp, Zea mays
cagcaatggcatggcgtcctcaccctcgcccttcttccctccaaacttcctcctccaaatgcggcagacgccctccgatcatgacccccaagaacaccaccaccttcctgctcctccccttcatcttcaccacaaccccttcctcccctcctctcaatgcccctccctgcaagacttccgaggtatggcgccaatgctgcggaagcgcccgacgatgtactgcggcgcggacgacgtcggcgtcggaggcgaggaggcgaactgcggcgcgacgaacgaggacgaggtgtcggacgacggctccctgcaagccggcgggcccggggagaagaagcggcggctgaacgtggagcaagtgcggacgctggagaagaacttcgagctcgggaacaagctggaaccggagcgcaagctgcaactggcgcgcgcgcttggc

SEQ ID NO: 1507 - DNA, 299 bp, Zea mays
ggacgctgggtccggccaggcccttggtgcgcttcgctggctcgcctcgctccagcgccagtgccagtacctcgccatcctctgctccaactctctccctgcccgcgaccacgccgcgatcacgccggttggttggtggagcatgctgaagctggcgcagcggatgacggacaacttctgcgccggtgtgtgtgcgtcggcggcgcagaagtggcggcgcctggacgagtggcgcacggcgagggaggagacgctgctgggaacggcggatcagcagccgcgggcgagggcgaggagaa

SEQ ID NO: 1508 - DNA, 268 bp, Zea mays
gcagctcaactccattaccaacaccgggccaaccatgggagctttcatctcttgaggtgcagctgcagataaaactggagtcgtcgatatgtccgacgatgaacaagaagaaggcagcggcatggaggcagaagtagccctgggcatcgatccttgctccgatgacaaggagctcaagaagcagctcctcaggaaatacagcgggtgtttgggcaacctgagaaaggagctgtgcaagaagaggaagaaagacaagctccccaaggag

SEQ ID NO: 1509 - DNA, 262 bp, Zea mays
gcagctcaactccattaccaacaccgggccaaccatgggagctttcatctctgcagctgcagctgcagataaaactggagtcgtcgatatgtccgacgatgaacaagaagaaggcagcggcatggaggcagaagtagccctgggcatcgatccttgctccgatgacaaggagctcaagaagcagctcctcaggaaatacagcgggtgtttgggcaacctgagaaaggagctgtgcaagaagaggaagaaagacaagctcccc

SEQ ID NO: 1510 - DNA, 276 bp, Zea mays
gcaaaaggcaatacagcaggagttgaggaagaaaaaaatgggacgatgaagtttgtagacaaagatatgagccagaatttggactgctcctgaaatttccaggtcgggtcgtgatttcgctgccggtgctatggaccttgaaactttggctttgtatggctctatgacggcagccaaaaaacatagatataccattacaactttacaagtcagctagctgcctctcattagttcgtgccagtcaactaacaagcgcatcattcagtttcgtcagta

SEQ ID NO: 1511 - DNA, 217 bp, Zea mays
gcagaaggcaatacagcaggagttgaggaagataaaaatgggacgatgaagtttgtagacaaagatatgtgccagacttaggactgctcctgaaatttccacgtcgggtcgtgacctcgctgccggtgctatggaccttgaaacttcggctttgtatggctctatgacggcatccgaaattcatagctatacctttacaactttacaagtcagctag

SEQ ID NO: 1512 - DNA, 370 bp, Zea mays
aattaaggcaaagaatctccaagtttgcttcgctcttgcattgaaccatggagtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgccagacgagctcctcgaggaagagtactacgacgagcagctgccggagaagaagcgccgcctcaccccagagcaggtgcttctgctggagaggagcttcgaggaggagaacaagctggagccggatcgcatgacggagctggcgcgcaagct

SEQ ID NO: 1513 - DNA, 280 bp, Zea mays
agcggaagaaagggaagctaccgaagatgctcggacggtgttactagagtggtggaacacgcactaccgctggccttatcctacggaggaagacaaggtgaggctcgcagcaatgaccggtctcgacccgaagcagatcaacaactggttcatcaaccagaggaagaggcattggaagccatcggaggacatgcggttcgcgctcatggagggtgttgccggtgggtcttctgggacgacactctacttcgatacaggcacaattggaccctgaatcata

SEQ ID NO: 1514 - DNA, 307 bp, Zea mays
agcggaagaaagggaaactaccgaaggatgctcggacggtgttactagaaagggtggaacacgcactaccgctggccttatcctacggaggaagacaaggtgaggctcgcagcaatgaccggtctcgacccgaagcagatcaacaactggttcatcaaccagaggaagaggcattggaagccatcggaggacatgcggttcgcgctcatggagggtgttgccggtgggtcttctgggacgacactctacttcgatacaggcacaattggaccctgaatcatacaccacttgggatgacaactggcca

SEQ ID NO: 1515 - DNA, 231 bp, Zea mays
gtacaagctgcgagttgagaatgtttacaagtcctacaatcgtctccagagaagttggcccaccaggataccagcagggagtgtttatgagtcctaaaaccatctcaagagaagtctgtcctccaggatttgggtctggagagaaccagggcaacgacactacatggtacaaacagagcgcgtttacaagtcctacaaccatctcgagagaagtcggtccgccagggtatg

SEQ ID NO: 1516 - DNA, 297 bp, Zea mays
  unsure (1)..(297): unsure at all n locations
acttcatggaatacaagctgtgagtcgggactatttatgagtcctgcgaccacctcaatagaacatggtccaccaggatatgggcctggagaaaaccaggagaatgacagtacaagctgcgagttgagaatgtttacaagtcctacaatcgtctctagagaagttggcccaccaggataccagcagggagtgtttatgagtcctaaaaccatctcaagagaagtctgtcctccaggatttggcgtctggagnagaaccagggcaacgacactacatggtacaaacagagcgcgttta

SEQ ID NO: 1517 - DNA, 293 bp, Zea mays
gttgcagcagcatgtacgtgttcatgcaatggaagcagtgatgggttgctgggagcttgaacaatctttacaaagcctaacaggggcatctccgggtgaaggcactggaggaaccatgtctgacgatgaagataaccaggtggatagtgaagccaacatgttcgatggaaatgatggatcagacggtatgggctttggccccctaatactgacagagggtgaacggtccttagttgagcgtgtacggaaggagctgaagaacgagcttaagcagggttacaaggaaaagcttg

SEQ ID NO: 1518 - DNA, 252 bp, Zea mays
cgacggggaacaatctttacaaagcctaacaggggcatctcctgatgaaggcactggagcgaccatgtctgatgatgaagacaaccaggtggatagcgaaccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgttgatatcagg

SEQ ID NO: 1519 - DNA, 382 bp, Zea mays
  unsure (1)..(382): unsure at all n locations
cccacgcgtccgcccacgcgtacggcagcatgtacgtgttcatgcaatggaagcagtgaggggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcacgagctaaagaacgagcttaagcagggttacaaagaaaaagcttgtgatatcaaggaagagattatgcgcaagcgcagagctgcgaaacttnctggagatactgcatctgtgctg

SEQ ID NO: 1520 - DNA, 267 bp, Zea mays
cagcaacggcttcttccgaggtgttccgatggcggtcctggccatggacgacgcgacgcgcgtggtgaagcggcccttcttcacgacacacgaggagctcctggaggaggagtactacgacgagcaggcgccggagaagacgcgccgtctgatggcggagcaggtgcagctgctggagcggagttccgaggaagagaacaagctggagcctgagcgcaagaccgagctggctcgccgcctggggatggcgccccgccggtggccgtg

SEQ ID NO: 1521 - DNA, 269 bp, Zea mays
cagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccagtggccgtgtg

SEQ ID NO: 1522 - DNA, 431 bp, Zea mays
  unsure (1)..(431): unsure at all n locations
gatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctagagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgccttaaggctgcttacgacgcactcgccgtcgaccaccagggcctnctggccgacaacgataaccttcgggcacaggtgatctccctgacggagaagctgcaaagcaaggaggacatcccgtcagcaacca

SEQ ID NO: 1523 - DNA, 148 bp, Zea mays
ggcgcgatcctgggcctgcagcctcgccaggtggccgtctggttccagaaccgccgcgccccgtggaagaccaagcagctcgagcgcgacttcgaccgcctcaaggcctccttcgacgctctccgagcggaccacgacgccctcctcc

SEQ ID NO: 1524 - DNA, 403 bp, Zea mays
ggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccgggtggaagacaagcagctcgagcgcgacttcgaccgcctcaaggcctccttcgacgctctccgagcggaccacgacgccctcctccaggacaacaaccgcctccgctcacaggttgtgt

SEQ ID NO: 1525 - DNA, 276 bp, Zea mays
  unsure (1)..(276): unsure at all n locations
ccgacgcgtccgggcgcgcaagctgggcctgcagcctcgccaggtggccgtctgggggggaaccgccgcgcccggtggaagaccaagcagctcgagcgcgacttcgaccgcctcaaggcctccttcgacgctctccgagcggaccacgacgcccttcttcaggacaacaaccgtcttcgctcacaagttgtgtcgttgaccgagaaactgcaagagaaggaggatgcgacgganggcggcgccaccgctgacaccgncgcngccgcggtggacgtc

SEQ ID NO: 1526 - DNA, 360 bp, Zea mays
cgaccgggtcgctgcctccgatcctcttgctgcccagcaccctggctacttcagccaggtagccaggtgagaccgactagctcgatctagctgctgaggcgtggccatggagggcgacgacgacggcccggagtggatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtc

SEQ ID NO: 1527 - DNA, 418 bp, Zea mays
gctgcctccgatcctcttgctgcccagcaccctggctacttcagccagctagccaggttgagaccgactagctcgatctagctgctgaggcgtggccatggagggcgacgacgacggcccggagtggatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtccaagcagctggagcgcgactactccgcgctccgcgacgactacgacgcgctcctctgcagctacgag

SEQ ID NO: 1528 - DNA, 444 bp, Zea mays
gctgcctccgatcctcttgctgcccagcaccctggctacttcagccagctagccaggttgagaccgactagctcgatctagctgctgaggcgtggccatggagggcgacgacgacggcccggagtggatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtccaagcagctggagcgcgactactccgcgctccgcgacgactacgacgcgctcctctgcagctacgagtccctcaagagggagagcacacgctt

SEQ ID NO: 1529 - DNA, 289 bp, Zea mays
ggagcgggtgaaggttggaaaggccaaagtttggaaaaaaataagacctgaaaaggagcttgaacgagccaaggcagaaatcctccaatgcaagttaagaatccgtgaagcttttcgaaatatggactctcttttatccaaggggaagcttgaagaatctttgtttgattccgcagagaaatttcaagcgaagatatattttgtgctgtatgtggctcaaaggatgttactttacaaaatgacatcattctttgtgatggagcctgtgacagaggattccaccagaact

SEQ ID NO: 1530 - DNA, 146 bp, Zea mays
ctgtttgaaccctctgtcacaggctccatcacaaagaatgatgtcattttgtaaagtaacatcctttgagccacatacagcacaaaatatatcttcgcttgaaatttctcctgcggaatcaaacaaagattcgttctagatcgcga

SEQ ID NO: 1531 - DNA, 331 bp, Zea mays
agccaatatgccaggtgtgaagagaaaataactatgactccagctgccatctcaagggaagctggtcttccaggatatggtcctggtcctggagaaaactttcttcaggtcagttcaaggaatactagctgtgagcagagtgtgatactggctcctaccgctatcgcaagagaagttggtccaccaggatatgcgactggagaaaaccagggcaatggggctccatggaatacaagttatgagcgaagactatttatgaatcctgtgaccagctcaagagcagtcagtcctccaggatatgggcctgaagaaagccgaggcagtggcattt

SEQ ID NO: 1532 - DNA, 254 bp, Zea mays
cccacgcgtccgacatgatttctgaaaagttgatggtacaaattaatcttaacgaaggcattgaagaggatatcccaccgagccaatatactaccaggtgtgaagagaaattaactatgactcaagctgccatctcaagggaagctggacctccaggttatggtcctggagaaaactttcttcaggtcagttcaaggattactagctgtgagcagagtgtgataatggctcctagcgctatcgcaagaggagtt

SEQ ID NO: 1533 - DNA, 281 bp, Zea mays
ataatagcacaacctttgatgacatacaagtaatagaacccaatgttgggttgatagataaaccagctgcagatgtaaatgacatgatttctgaaaagttgatggtccaaataaatcttaacgaagacattgaagaagatatcccaccgagccaatatgccaggtgtgaagagaaaataactatgactccagctgccatctcaagggaagctggtcttccaggatatggtcctggtcctggagaaaactttcttcaggtcagttcaaggaatactagctgt

SEQ ID NO: 1534 - DNA, 443 bp, Zea mays
tcgcccacgcgtccgctgcagatgtaaatgacatgatttctgaaaagttgatggtccaaataagggttaacgaaggcattgaagaagatatcccaccgagccaatatgccaggtgtgaagagaaaataactatgactccagctgccatctcaagggaagctggtcttccaggatatggtcctggtcctggagaaaactttcttcaggtcagttcaaggaatactagctgtgagcagagtgtgatactggctcctaccgctatcgcaagagaagttggtccaccaggatatgcgactggagaaaaccagcgcaatggggctccatggaatacaagttatgagcgaagactatttatgaatcctgtgaccagctcaagagcagtcagtcctccaggatatgggcctgaagaaagccgaggcagtggcatttcctggaatacaagc

SEQ ID NO: 1535 - DNA, 182 bp, Zea mays
cggaaaagcgtggacgagcctgggagagccgccgggcgtggtcctaagcgcaccacatcggtgtgggtgcccgtggctccggagaagctcttcaacttcctccgtgacgagcagctgcgtgcggagtgggacatcctcagcaacggaggcccgatgcaggagatggccaacatcgccaaggg

SEQ ID NO: 1536 - DNA, 460 bp, Zea mays
ttgcggaggcagtcatgcagccaccgcaatagcaggacgcgcgggtcgacgcatccctctacacgtgagtcgtgctagagcggaaaagcgtggacgagcctggggagccgccgggcgtggtcctaagcgcagccagatcggggtgggtgcccgtggctccggggaagctctgtcagcttcctccgtgacgagcagctgcgtgcggagtgggacatcctcagcaacggaggcccgatgcaagagatgggcaagatcgccaaggggcaggagcacgggaactcggtgtccctcctcagagcgagtgccatgagtgccaaccagagcagcatgctgatcctccaggagacttgcactgatgcatcaggctcgatggtcgtgtatgcgccagtggacatcccggggatgcagctcgtcatgaacggcggggactcgacctacgttgctctgctgccgtctgggt

SEQ ID NO: 1537 - DNA, 203 bp, Zea mays
gcacgaggtttgtgccgcacgcatgagctgtaaggaggccatgcttaattattctgttgccgttgctactctatctatatgcgcctatgcctccgtgcatgaactatgctttaggtggttgctgctccacactgtcgtggtgtgcttttgcttttgtgtggtcgtattgtatgcgtaacctgacagatggatccctgattgct

SEQ ID NO: 1538 - DNA, 231 bp, Zea mays
gctgcacgcttgagctgtaatgtggccttgcttaattattctgttgccgttgctactgtatctatatgcgcctatgcctgcgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcct

SEQ ID NO: 1539 - DNA, 287 bp, Zea mays
  unsure (1)..(287): unsure at all n locations
caggtatgcagctgccgagggtttctataaactagctatggcctatgcacccgttccagatcttcacattatgacggttgcttcatctgtgtgatgcacaccaggagatgcaatcatgggctgaagcagcacaatgtgcagttgctgtagctggcgtgatcatgcaggcacttgttggaaggaatgatgctgtgtggagcaaggagcatgttgcttcgctgcgcaagatttgccctattgtcaacactgatgtgactgcangaacatctgcagctgaagtcgaggga

SEQ ID NO: 1540 - DNA, 363 bp, Zea mays
  unsure (1)..(363): unsure at all n locations
acggacagccactgccagtcaccaaacactgcacatcagggttcaccaagctgcggcggtagcagcagcagcagcagcacggggtctctagtcacggtggcattccagatcctggtgaacaacctgcccaccgcgaagctcaccgtggagtcggtggagaccgtcagcaacctgctctcctgcaccatccagaagatcaagtctgcgctccaggccagcatcgtcacgccctagctattagcgggcatttgacatggattccggccgccggttctcagaaaaaaggacggagtantcggatgccatgtcaaatgcttagctagaggacgacatgctgtgacggcgcagatgctaaacaagggt

SEQ ID NO: 1541 - DNA, 314 bp, Zea mays
ccacggtccgaccacgcgtccgacacggtccgggacctggtggatgtgtccattgacggattggtgagagatcacaactctggaacagcatccaacgccggaaatatacggtgcaggaggttgccttctggctgtgtgatgcaggacactcccaatggctactgcaaggtcacatgggtagagtatacggaatacgacgaggcgtcagtacaccagctctatagaccactcatccggtccgggctggcctttgggagcaggcggtggcttgcaatgctgcagcgccagtgcgaatgcctggccatactcatgtc

SEQ ID NO: 1542 - DNA, 285 bp, Zea mays
atgggcagtagtggatgtgtccattgacggattggtgagagatcacaactctggaacagcatccaacttcggacatatacggtgcaggaggttgccttctggctgtgtgatgcaggacactcccaatggctactgcaaggtcacatgggtagatacatagaatacgacgaggcgtcagtacaccagctctatagaccactcatccggtccgggctggcctttggggcaggctgtagcttgcaatctgagcgcagtgcgaatgctgcatatcatgtcctgatacag

SEQ ID NO: 1543 - DNA, 294 bp, Zea mays
tgagcaattacggaacacaagcaaggtcgctgccagtgatggtattggcaaggatgatatggcgaactttgcgcttatgggtggtggagcagaccacctgaggggaaacagcgtgaacacgttcagccaggctcacaacatttggaggcctcaaagagggcttcctgagcgtgcagtgtctgttcttcgctcatggctgttcgagcacttcctacatccgtacccaactgatagtgacaagcagatgctggctaaacagacaggcctaactaggaaccaggtgtcacactggtt

SEQ ID NO: 1544 - DNA, 355 bp, Zea mays
cacttcaagtgtctgaaggggatggtgatgagccagctacggaacacgagcaaggtcatcgccaaccatgggattattgccaaggacgatatggcgaacttcgcgctcatgggtggtggagcaggcctcctgaggggaaacagcgtgaacgcgttcagccagcctcacaacatttggaggcctcaaagagggcttcctgagcgtgcagtgtctgttcttcgctcatggctgtttgagcacttcttgcatccgtatccaactgatagtgacaagcagatgctggctaaacagacagggttaacaaggaaccaggtgtccaattggttcatcaacgcaagggtgcgtctctggaagc

SEQ ID NO: 1545 - DNA, 305 bp, Zea mays
cagttcaagtgtctgaaggggatggtgatgagccagctacggaacacgagcaaggtcatcgccaaccatgggattattgccaaggacgatatggcagtattcgcgctcatgggtggtggagcaggcctcctgaggggaaacagcgtgaacgcgttcaggcagcctcacgacatttggacgcctcaaagtaggcttcctgagcgtgcagtgtccgttcttcgatcatggctgtctgagcacttcttgcatccgtatccaactgatagtgacaagcagatgctggctaaacagacagggttaacaag

SEQ ID NO: 1546 - DNA, 297 bp, Zea mays
gttatcaggaagaaacttggagaggatgacgatgcatctggcaaagagggcaaactaattcgccttcgttatatcgatcagcaaataaggcaacagcgagctttccaacagtatggtatgctacagcaaaatgcttggaggccacagagggggctacctgaaaattcagtctcgattctccgggcttggctttttgaacacttccttcacccgtatccaaaagactctgaaaagctaatgttatcgagacaaactgggttaacaagaagtcagatttcaaattggttcatcaatgcc

SEQ ID NO: 1547 - DNA, 217 bp, Zea mays
gcgagctttccaacagtatggtatgctacagcaaaacgcttggaggccacagagaggactacctgaaaattcagtctcgattctccgggcttggctttttgaacacttccttcacccgtatccaaaagattctgaaaagctaatgttatcgagacaaactgggttgacaagaagtcagatttcaaactggttcatcaatgcccgtgtccggctgtgg

SEQ ID NO: 1548 - DNA, 290 bp, Zea mays
atggcgtttacgagtcctacgaccaaccctagagtaggtccgccagggtatggacaggaaaaccagggcagtcgtgtttcttggaatacgagttatgagcagggagtgtttatgagttctacaaacatctcaagagaagccggtccgccaggttatgggcctggggaaagtcagggcaatatcacttcatggatttcgacaggcgggcagagaatgtttacaggtccttcaactatcccgaacgaagtcgggcagcaaggatatggcccttcaggaatcccgggaacgga

SEQ ID NO: 1549 - DNA, 266 bp, Zea mays
aaaagtcagggcaatatcacttcatggatttcgacaggcgggcagagaatgtttacaggtccttcaactatcccgaacgaagtcgggcagcaaggatatggcccttcaggaatcccgggaacggatggctcaaggagtatggacttgaaagcctttccaccaggatatggacctgctggagaaaaccagggcggtggtgcttcagggagcgtcataagcccccatgctcggtctgcagagaacgtagagttttcagacgacgctag

SEQ ID NO: 1550 - DNA, 285 bp, Zea mays
  unsure (1)..(285): unsure at all n locations
acgaatcggngcagcaaggatatggcccttcaggaatcccgggaacggatggctcaatgagtatggacttgaaagcctttccaccaggatatggacctgctggagaaaaccagggcggtggtgcttcagggagcgtcataagcccccaagctcggtctgcagagaacgtagagttttcagacgacgctagaaaaaaggctatacagcgggagctgagacggcggcagaagttcaggtgatggccgtgatgcgaatttctgatcttgctcacgaattttgactacg

SEQ ID NO: 1551 - DNA, 252 bp, Zea mays
gagaagccggtccgccaggttatgggcctggggaaagtcagggcaatatcacttcatggatttcgacaggcgggcagagaatgtttacaggtccttcaattacccgaccgaattcggctgcaaggatatggcccttcaggaatcccgggaacggatggctcaaggagtatggacttgaaagcctttccaccaggatatggacctgctggagaaatccagggcggtggtccttcagggaccttcataagcccc

SEQ ID NO: 1552 - DNA, 221 bp, Zea mays
gttctacaaacatctcaagagaagccggtccgccaggttatgggcctggggaaagtcatggcaatatcacttcatggatttcgacaggcgggcagagaatgtttacaggtccttcaactatcccgaacgaagtcgggcagcaaggatatggcccttcaggaatcccgggaacggatggctcaaggagtatggacttgaaagcctttccaccaggatatgga

SEQ ID NO: 1553 - DNA, 365 bp, Zea mays
cggcgggcagagaatgtctacaggtccttcaactatcccgaacgaagtcgggcagcaaggatatggcccttcaggaatcccgggaacggatggctcaaggagtatggacttgaaagcctttccaccaggatatggacctgctggagaaaaccagggcggtggtgcttcagggagcgtcataagcccccaagctcggtctgcagagaacgtagagttttcagacgacgctagaaaaaaggctatacagcgggagctgagacggcggcagaagttcaggtgatggccgtgatgcgaatttctgatcatgctcatcgaattgtgactacggattactactttttaagactacatatcgagtcttgatg

SEQ ID NO: 1554 - DNA, 273 bp, Zea mays
caaaacttatgactatgttggacgaggtggataggaagtacaaacactattatcatcagatgcaacttgtaatgtcatcgtttaatatggttgctggtgctggagctgccaagccttatactgcagttgccctccagacaatctcacggcatttccgatgtctaaaggatgctatcaatgatcaaattagtgttatccggaagaaacttggagaggatgacaatacatccggcaaagagggcaaactaacccgccttcgttatattgatcagc

SEQ ID NO: 1555 - DNA, 155 bp, Zea mays
tggtgctggagctgccaagccttatactgcagttgccctccagacaatctcacggcatttccgatgtctaaaggatgctatcaatgatcaaattagtgttatccggaagaaccttggagaggatgacaatacatccggcaaagagggcaactaac

SEQ ID NO: 1556 - DNA, 288 bp, Zea mays
caacagtttcagaaataaatcggcttcgggatagacagttattcccaaagttaatggaccttgttgatggaatggccaagatgtggagttctatgtaccgccatcatagaagtcagttcctgatcatttctggaataagaggtttcgagattcctcctattccaagggagacaactgattctcattacatccagacttgtgagctacgtgacattgttagggagtggcatacgcagtttgagaaattgatggacaatcagaaagcatacatcagagcactcaatgcat

SEQ ID NO: 1557 - DNA, 264 bp, Zea mays
gctcagtcctcgccaccgcccactccgtcgccaaccaatggcctccgccatggagctctcgctcctcaaccccgccgcgacgcaccgccaccgcggcggcctcgccggcctgcccctcgcacggcgctccgtggtccgcttccgcgtgtccgcctccgccgctgccaccgcgccgcccaagtcctcgggccccaagaatcggggcaagacggagatccaggagacgctgctcacgccccggttctacaccacggacttcgacga

SEQ ID NO: 1558 - DNA, 277 bp, Zea mays
ggcctccgccatggagctctcgctcctcaaccccgccgcgacgcaccgccaccgcggcggcctcgccggcctgcccctcgcgctgcgctccgtggtccgcttccgcgtgtccgcctccgccgcggccaccgcgccgcccaagtcctcgggccccaagaagcggggcaagacggagatccaggagacgctgttcacgccccggttctacaccacggacttcgacgagatggagcgcctcttcaacgccgagatcaacaagcagctcaaccaggcggag

SEQ ID NO: 1559 - DNA, 253 bp, Zea mays
  unsure (1)..(253): unsure at all n locations
gcggcatggttcgacatggagcacgcgaggtggcaggaggagcacggcaaggtgatgcgccacctgcgggcggcgctggaggcggagtacgccgcgacggcgacgacgccgccgagcgctgcttcctctggatcggcggcttccgcccttcagagctcatcaagatagcggcccggcacgcggagcccctgacggagcagcaggcgatgagcgtctgctgtgtgcagcagtgggcgagggacgcggangcggc

SEQ ID NO: 1560 - DNA, 304 bp, Zea mays
ctcaagatcctgagcccgcacctggacccgctggccgacgcgcacgcactgccggtgcggccgcctgccgcacacgtcggcgcaggccgaggacgcgctgtcgcagggcatggagaagctgcagcagaacctcgcggagaccctgacggccgacgccgacccgttcgggccccccgacccctacatgctgcagatggccaccgcggtgggcatactgaaagagctcgtcaacttcgtgacccaggcggaccatctccggctgacgacgctgcagcagatgcacaagatcctgacgccgcggcag

SEQ ID NO: 1561 - DNA, 289 bp, Zea mays
atcaggcaaacgatacagcccttccctcttcaatcctctcgtcatttcctctcgcttctgctcagctgcaacccagcgcgtagatcttattcttggacgagaactctcctcaagctctccgatttctgttctcgcgccgcttagcaattcaaccccgaaattcttttgcggcgcaatcttcacctgaatcttgggtcgtagccaagaagatgaacaaagacaaagctccgatgccgggagacggcggccccagcgacggcttgccgccgcagtccacgcgccgtgtcgg

SEQ ID NO: 1562 - DNA, 314 bp, Zea mays
gatatcacattgctggcacaaaaggtgtcttttactcaagggaaccatatgtcaatgattctgctgctcatgttacccgctttattggacttgctaatgttggaaacaaagagaagcagaaatttattcatgcgatttctcctactccagcatctgtcatgtccagtgctgatatcaatgccaagcctccaaacgccactttgtcaccatatgttggttcagcaaaatcagttcctatcgaagaagctccaaaacgtgcagcggagaacatagattcacaatattggcgtcatgatgtcaagcggcaaaggcat

SEQ ID NO: 1563 - DNA, 259 bp, Zea mays
gaatgatgtaatgttgaagagagttgctgctttctcaaagcggctgcttcaggtggctcttcaacggcctcctcaatatggttgcggatgccttttcattctgtcagaagtccttaatgcaaagccaccattatgggggattgtgctccagaatgaatctgttgatgatggttatgaacactttgaagacattttagagattcccgaggactcttctgttgcctcagcagtgctacataaacataatgtaaaagtagct

SEQ ID NO: 1564 - DNA, 302 bp, Zea mays
cggacgcgtggcgtgacgcgtgggcagctgacggggcccggtggcggcagccacagcagcggcggctacgacgacgagcggaagaacatccggaacacgaggaacaaggagtctgcgctgcgctccagggcaaggaagagggcctatgtgcaggagctggagaaggaggttcgtcgcctggtgaatgagaacctcaagctcaagaggcagtgcaaacaactgaaactagatatggctgcactggtccagcaaagcagcagcaagagcagctcccacatcagaagaacctcctcatccactca

SEQ ID NO: 1565 - DNA, 315 bp, Zea mays
tggtaatgtggccaatgtaactgctgatgcctgtcatgcttttggccatcctgatcaagacaagtcatttaaaaggcgctcagggcaaagatctagggtccgaaaacttcaatacatcgctgaacttgaaagaactgtcgaatcgcttcagaacattggagctgatttggccgtcagaatgtcatcacttttccatcttcacaatgctctatcaatggaaaacaagcaactgaggatacatatttccagtcttcagcaagcaaaactgattaaggatggtcagacgcaggccctaaagaatgaagctgaaaggtt

SEQ ID NO: 1566 - DNA, 240 bp, Zea mays
gagagagcaaagtgatttgctgtctcctggcgatcgttgctcgtgaggcctagtgatggcagatgctagctcaaggactgacacctcaattgttttagacgacaacgacaagaatcataggatggagaatcgaagtggtgcggttgtaccttctaattcttcagataggtccgacaggtctgataaacctttggaccaaaagacaatgcgacggcttgcccaaaatcgtgaggcagcaag

SEQ ID NO: 1567 - DNA, 313 bp, Zea mays
cggacgcgtgggggcggcggcggcgacgacttcgaccgcctcgaccacgaccagctcctgtccatgttctccgacgtcgacgtctccgtctccggcagcgcaggggagagggcgcagctcatggacccggggggtgcggacgacggggtggcggactcgtcgccggctgccgcggacggcgtcgctgagcccaaaagggtcaagaggatattggcaaacaggcagtcggctcagaggtcacgagtgaggaagctgcagtacatctcggagcttgaacggagcgtcaccagtctccagatggaggtgtcagcgc

SEQ ID NO: 1568 - DNA, 299 bp, Zea mays
tgctcgatgagtgcctcaccgtgctcggtgtggaacggctcagtatcgacgaggtgcagcgcatcgagtggaagcatctcaatgacaagatgaagaagtgggtgcatggggtcaagacagttgttcgctgcctgctcaccggtgagcgccggctctgtgaccaggtgcttgctgtgtccgacgagctccgggatgagtgctttgtggagtccaccaagtgctgcatcatgcagatccgtaactttggggatgctgtctctgtgtgcactcgctcgcccgagaagctttcccggatcctt

SEQ ID NO: 1569 - DNA, 304 bp, Zea mays
gcagaatctcagcttgctgcagttaccacaaggataatgcaggccctacagaataacctagatgggaaatctaaacaatataaggatcctgcattgacacacttgtttcttatgaacaacatccactatatggttagatctgttcgcagatcagaagcaaaagatatacttggtgatgactggattcagaggcatcgcaggattgtgcagcaaaatgccaatcaatataaacgtgttgcttgggcaaagattcttcagacactttctgttcaaggtgcgggcagcggtggtgaccttaccagca

SEQ ID NO: 1570 - DNA, 289 bp, Zea mays
ctgcaattcacttgtaatgcagagggacacctctggtttaaccactgagaacagggagctgaagctccggctgcaggccatggaagaacaagctaaactccgagatggtacgtagtctttctccggaaggtcttgagccactatcataccaggcccagaaagcgactcactttccctgtttcaagatcattacaaggcaaacgatatcaaccgatcagttatctcctgtcctgaccaactttattctcttgaaaaatactgtagttatcttctgagcagataggtagat

SEQ ID NO: 1571 - DNA, 316 bp, Zea mays
gtaggccgccagacagggcccatagaaggctcgcgcagaacagagaggctgctcggaagagtcgcctgcggaagaaggcctacatccagcagctagagacaagccgcatgaagctgtcgcagctagagctagagcttcaacgggcgcggcagcatggtgcatatgcgaatagtgggagcatgggagactcggctctcggctacagatgcccgatagatccaggtgtttctgtgttcgagatcgactacagccactgggtggacgagcagaagagacacacggcggtactgacgtcggcgctccaggggcagcagac

SEQ ID NO: 1572 - DNA, 268 bp, Zea mays
gccgccgcttccgccgcatcaagcgctagaactaggaacccctcccaaaggatctcaagaagacaaggacaccgtcgagtcgccgccagtcgctcgatggggtgcgggcagtcaaagatcgatcaagaggaggcggtgtttcgatgccgggagcggaagcgactgatggctgacgccgtggcctcgcggacggttttcccgccgccaacacgggctacactgtccgcctgagagagcaccggcgacgcgctatccgatttcgcccggg

SEQ ID NO: 1573 - DNA, 133 bp, Zea mays
cggacgcgtgggctggcaatgacatccagaatgttgcagcttgttgttaagtcctgcctcattctggcaatcgacatccagaaaaaaggaaactaatcgagctatcatgcaatgcttgcatagcatggcccta

SEQ ID NO: 1574 - DNA, 251 bp, Zea mays
gacgacgagatctcgccctacctcatcgccccggacaccgtcagcgtcctcagggacatcgccgacgtcatgctgcgcgccggctacgcgcccgagctgtgccaggtatacggggaggtgcgccgggacacgctcatggaatgccttgccgtgctcggggtcgacaagatgagcctcgaggaggtgcagcgggtggagtggggcgtgcttgacggcaagatgaggacatggatccaggcgctcaaggtcgt

SEQ ID NO: 1575 - DNA, 230 bp, Zea mays
ctcgccgagctcgcgcttgttgaccccaagcgtgccaagaggattttggcaaaccgccagtcagctgctaggtcgaaagaaagacagatgcgctacattgcggacttgaaaggaacgtacagactctccaattagaagcaactacactatcagctcagctggccatgttgcagcgagatacgactggtatgacaagtgagaatagtgatctgaagatacgtgtgcagaca

SEQ ID NO: 1576 - DNA, 249 bp, Zea mays
atagctgcaaacatagctgtgaccacatgatgatgacgatttactacagcaggcacttgcaatgtcaatggagggtggtgcttcaggatctgcagctgtgactgactctgctatggcagaagctagtgcagttgaccctgacttagcgttggcaagagaagaaggaagacaagtaagacaaaacagaagacgagaagaactgcttcaagctggagtgatgtcgctgtggtgcttttgtgactgatcatc

SEQ ID NO: 1577 - DNA, 255 bp, Zea mays
acgttgcagaacatatttttgatgaataatctgctgtatattgtgcagaaggtgaaagattcagagctcaagacattgcttggtgataactggattcgcaagcgtcgtggtcagattaggcaatactctacagggtatcttcgatcatcatggactagggtgttagcttgcctgagagatgatgggcttccgcacacgatgggttcatcaagcacactcaaagccgcattgaaggatagattcaaaaactttaac

SEQ ID NO: 1578 - DNA, 286 bp, Zea mays
  unsure (1)..(286): unsure at all n locations
atagctcagcagttggttcaggctggaaatcagcaaacttgctataaaatctacagagattaccgtgcttcagcactagaggtgagccttcggaagttaggagtggaaaaacttactaaagatgatgtacaaaaaatgcaatgggaggctttggaggctaaaattggaaactggatacattttatgcgaatcgcggtcaaattattactagcaggggaaagaanaatctgtgatcagatttttgatggtgtgaattttaacaagggccattgttttgctgaactca

SEQ ID NO: 1579 - DNA, 302 bp, Zea mays
cccacgcgtccgccaggttttgctttatgctggttcatttgtctacggacaatggactagttgctgcactgtttctgtgattcaccatgggaagcagtggagcagatacaccgtctaaggagcagcagccacctgctacctcaggtgctgcaataccacctgtttatccagattggtctagcttccaggcatatcccccaatcccaccacatggattcttcccctcacctgtggcatcaagtccacagggtcatcctttcatgtggggagctcaagctatgattccaccttatggaacaccg

SEQ ID NO: 1580 - DNA, 307 bp, Zea mays
  unsure (1)..(307): unsure at all n locations
ggccgggctactgcaagagatttagtgaaacagaggctcaaatcattcaatgctagcttcgacgagatgtttcaaaagcagtctaaatgggtgatatcggatagggatttgcagcagaagacatgccacctcgtggtgcaggccgtagtgcctgtttacaggagcttcatgcagaattatgggccgcttgttgagcaggacgttatgcgagcaggtatgtgaagtacagcgccgaggatctggatangngctcaaaagctttcctgtccaagccaggnnggcaantnancccgggctttccaacana

SEQ ID NO: 1581 - DNA, 277 bp, Zea mays
cccacgcgtccgcgagatgttcctcgagaacggtggcaagctcccaggaccgccggaaccgtcggcgcatccgcattcgacgccgccgcggccacggcaccatcacagcatgtctatggatgggtccacgtctttgtttggttccgccgccgccgggacgcctgggaggtcgggcgctgatgccaagaaggctatttccgacgctaagctcgccagactcgcgcttgttgaccccaaacgtgccaagaggattttgggcaaccgccagtccactgct

SEQ ID NO: 1582 - DNA, 240 bp, Zea mays
gtggaggggtatgtacgagtgccatcaagttcagacccacatcgtgcagcagctggagtacctgaacaatgctcggaataccaacccgacttccaatggccaccggcaagcagctcttcagctcgagatagaggttgacaggtgttattcagccttctgtagtctggtgaaatcccagagagactacgtctactcattgaccggctggcttcgtctatccctgttctgccaccacgaccc

SEQ ID NO: 1583 - DNA, 252 bp, Zea mays
cccacgcgtccggaggcctgaacgataattttgagattgatgatagatttgaaactcatgctgcagttctagatagaatgcttgcttgggagaaaaaactgtatgacgaagtgaaggctggggagcttatgaaaaccgattatcagaagaaggtgtctctattgcagaagcaaaagaaatggggtgttaaacttgaaaccttggagaagacaaaagctgctgttagccaattgcacacaaggtacattgtag

SEQ ID NO: 1584 - DNA, 274 bp, Zea mays
cggacgcgtgggcggacgcgtgggcggacgcgtgggccggggttgataatccaaacatgactccattggggcactgcgtgctcaacctgatcacacacctacagtgcaagatcaatgagaaatcgaggctgtatgaggatgaagcgttgcagaacatatttttgatgaataatctgctgtatattgtgcagaaggtgaaagattcagagctcaagacattgcttggtgataactggattcgcaagcgtcgtggtcagattaggcaatactctac

SEQ ID NO: 1585 - DNA, 266 bp, Zea mays
gtccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtg

SEQ ID NO: 1586 - DNA, 295 bp, Zea mays
ccggaagctccagtatattgcagagcttgagagaagagttcagtccttacagacagagggaatagaagtaactgctgaaatggattttctcggtcagcaaaatatcatgttagacttggaaaataaagccttgaagcaacggcttgagagtctatctcaggagcatctcattaaacgttatcagcaggagatgtttgagagggaaattggccgccttagaacattgttccagcagcagcaacagcaacaacatgtgccgcagcagcaggctcctacccatagccgcagtaacagt

SEQ ID NO: 1587 - DNA, 287 bp, Zea mays
aaaggctactaagttaggagagatcttgggtgatgtgtggctgcgagagcatgaacaatacaaggactactatttgtcaatgttcatcagggagagctggggagcactttcgccactactgaaccgggagggattaatactgttctccaagggccaggctacggcaagggacctggtgaagcagcgcctcaaaacattcaattcaagctttgatgagatgcattgcaggcaatcatcatgggttataccagacaaggatttgcgggagaggacatgtaatcatgtgg

SEQ ID NO: 1588 - DNA, 309 bp, Zea mays
gcttagaaaaagtacaatactttatgtatgaattcagaaatcccaatgatattcattctgaatatgtgcaaatgcagaatgttgcatttgacaaatgactactctcaggcctgcaaactgcacattacaacgtgaagttggttattgaaagggcgcccatagctgcaaacatagctgtgaccacatgatgatgacgatttactccagcaggcacttgcaatgtcaatggagggtggtgcttcaggatctgcagctgtgactgactctgctatggcagaagctagtgcagttgaccctgacttagcgttg

SEQ ID NO: 1589 - DNA, 287 bp, Zea mays
agcgacgtcaacaacagttccaggggctgtagtcccagcagagcagtggacacaggatgaacatgaactcaaaaagcagagaagacagcagtccaatagggagtctgcacgtagatctaggttacgtagacaggctgaatgtgaggacttggctcaacgtgctgatgtcttaaagcaggaaaatgcttcacttagagatgaagtaaaccgtatcagacaagagtacgaggaacttctatcaaggaatatctcactaggggaaaaacttgaaggaaaacagcacaact

SEQ ID NO: 1590 - DNA, 270 bp, Zea mays
gccagaaaaaaggaaactaatgctatcatgcaatgcttgcctacattggtcctaactagattattgggaggtgcaattgtagtatgcacattaactccttactttattgcagttaattgttaccaggttgtgataatgttgatgccaaccttttgtgtgggtgtttcctgtttcagatctatcttggcttatcttttagaagccaagatgtgactgaagctataggctgtgacccaattcactatatctgttagaaatagtggataagtc

SEQ ID NO: 1591 - DNA, 202 bp, Zea mays
caatcagatacggaagacctcttatgatcagcaccaacaggtccgccaaatccggcagaagatgatggacatcatgacccgagaggtgcagacaaatgacttgaaagacgtggtcaataaattgattccagacagcattgagaaggacatagaaaaggcttgccaatctatttatcctctccatgatgtcttcgttagaaaa

SEQ ID NO: 1592 - DNA, 197 bp, Zea mays
aaatcatatgctgcaatatacccacatgctggtggtttcctgcatccactcatgcccctagtggtaaacccattgagtgcagagccagctaagtctgggaacagcaaggataatagtttaaagaagaaactacaggaaattgatggatctgctgtgtcaagtggcaacagtgagaaaacaagtggggatcacagcct

SEQ ID NO: 1593 - DNA, 149 bp, Zea mays
  unsure (1)..(149): unsure at all n locations
tgaaccatgtgtgagcaccggtagtgccttcaaagttagtggtgcgacatcaaccgaatggccagctaaggacgacaaggaatcgaagcgtgaaaggaggaagcagtcanacagggagtctgcccggcgctcaaggctgaggaagcagg

SEQ ID NO: 1594 - DNA, 329 bp, Zea mays
  unsure (1)..(329): unsure at all n locations
tgcagatcctgcagacggaggccaccactctctccgccagctcacgcttcttcagcgggactcgcngagatcgcgacgcagaacaacgagctcaagttccggctgcaggccatggagcagcaggcgcactgcgtgacgcattgaatgaggcactgacagccgaggtccaacgcctgaagctcgcgactccagagctcggggattcttgctcgtccagcaacctagctcagcagatccaaatcagcgttcaggaccagatgtttcaactgcatcagcagcaggcaacgcctataccgttctaccagctgcagcaggcgcacgaatggcgc

SEQ ID NO: 1595 - DNA, 249 bp, Zea mays
ccttcaagcagctatagctagcataattaactcatgggtgcatagagatatgccgccgacgacccatatctatgggttcctccccttgcactgcatcttcttcttcctcctcctcgacctccttcaattattcctagtgtttgcttctcccttccttgacctttgctctgaaccattgatagttacttattgggcatggagcacgtcatctcaatggaggagatcctcgggcccttctgggagctgctg

SEQ ID NO: 1596 - DNA, 260 bp, Zea mays
cttcaagcagctaacataattaactcatgggtgcatagagatatgccgccgacgacccatcatatctatggttacttattattgggcatggagcacgtcatctcaatggaggagatcctcgggcccttctgggagctgctaccaccgccagcgccagagccagagccagagcgagagcagcctccggtaaccggcatcgtcgtcggcagtgtcatagacgttgctgctgctggtcacggtcatggtggcggcgacatgat

SEQ ID NO: 1597 - DNA, 238 bp, Zea mays
ctccttcaagcagctatagctagcataattaactcatgggtgcatagagatatgccgccgacgacccatatctatgggtccctccccttgcactgcatcttcttcttcctcctcctcgacctccttcaattattcctagtgtttgcttctcccttccttgacctttgcttggacccattgatagttacttattaggcatggagcacgtcatctcaatggaggagatcctcgggccctt

SEQ ID NO: 1598 - DNA, 256 bp, Zea mays
catgacggagctccaggccgtgctgcagccccagatcatcgacgcgaacctgggggccatcgtcgaggactgcatgcggcactacgacgagctgttccacctgagggccatgctcgcaagatccgacgtgttccacctgatgaccggcctgtgggcgaccacggccgagcgatgcgtcctctggatgggcgggttccgtccttctgaaatcctcaagatgctgataccgcagctcgaccctctcgcggagccgcag

SEQ ID NO: 1599 - DNA, 254 bp, Zea mays
gctgacaccatggccaacggctcgctgatcgacgacaccagcatgagcttcatgggtcaaatggcccttgcccttggcaagctgtccagccttgaagtttttgtgatacaggctgataacttgaggcagcagactcttcatcagatgcgccggattctgacagttcggcaggcagctcgctgtttccttgccatcgccgggtaccagaaccgcctgcgcgccctaagctccctctgggtttctcggcctcgaga

SEQ ID NO: 1600 - DNA, 274 bp, Zea mays
gcgacacagacgttgcatcaaatgcaacgtatcctaacgatccgacaggcttctcgtgctcttcttgcaatccacgactatttttcacgattgcgcgcgttaagttctctgtggcttgctaggccacgtgaataacgaagggccgtcagtattttgagttccctctgccttacggtgctgctgcgtcgttcgcagcgatggcgcacagatctttggtggtactgtttttgttgtacaattacttttggccgctgcttggtccaaattgtactca

SEQ ID NO: 1601 - DNA, 216 bp, Zea mays
gcgactggctgatatgactcagaaatacaaggacgcttccgttgacaataaaaatctaacagttgatgttgagactatgagtagaaaggtgaacatagccgaggaagctgtcaggaggctaactgggatcaccctcatgctaccgaccgcgtttgcgaagcacgcgagcagcgcgcctactgtcatcatgaccatctgatgcagcttctgcttctg

SEQ ID NO: 1602 - DNA, 391 bp, Zea mays
cccacgcgtccgcccacgcgtccggcaagatattcttggtattaccttgatcgttacaggcatccaaattgttagaatacctaaccttaaggtgggttcagccttcctgggttgtgccttcttatatgacatcttctgggtttttatctccaagatgttgttccatgaaagtgtgatgattgtggttgcacgtggtgacaagactgatgaggatggtgtacccatgctgttaaagattcctcggatgtttgatccatggggtggatacagcatcataggctttggtgatatccttcttcctgggctgttggttgcttttgcattaaggtatgattgggctgccaagaagaccttgcaatctggctactttttgtggtcaatggtggcatat

SEQ ID NO: 1603 - DNA, 331 bp, Zea mays
ctcgactcctcgttctgcaggatcctggcgaaccggcagtctgcggcgaggtccaaggagaggaagatcaagtacaccagtgagctggagaggaaggtgcagacgctgcagacagaggccaccacactttcggcacagctcacgcttcttcagagggacacctctggtttaaccactgagaacagggagctgaagctccggctgcaggccatggaagaacaagctaaactccgagatgctctaaatgacgccctgagagaagaagtccagcggcttaagatagccacagggcaggtccctaacataaacgggaatcccttcaacggaggac

SEQ ID NO: 1604 - DNA, 280 bp, Zea mays
ggcgaaccggcagtctgcggcgaggtccaaggagaggaagatcaagtacaccagtgagctggagaggaaggtgcagacgctgcagacagaggccaccacactttcggcacagctcacgcttcttcagagggacacctctggtttaaccactgagaacagggagctgaagctccggctgcaggccatggaagaacaagctaaactccgagatgctctaaatgacgccctgagagaagaagtccagcggcttaagatagccacagggcaggtccctaacata

SEQ ID NO: 1605 - DNA, 281 bp, Zea mays
ggtggtcctcgactcctcgttctgcaggatcctggcgaaccggcagtctgcggcgaggtccaaggagaggaagatcaagtacaccagtgagctggagaggaaggtgcagacgctgcagacagaggccaccacactttcggcacagctcacgcttcttcagagggacacctctggtttaaccactgagaacagggagctgaagctccggctgcaggccatggaagaacaagctaaactccgagatgctctaaatgacgccctgagagaagaagtccagcggc

SEQ ID NO: 1606 - DNA, 272 bp, Zea mays
catggattatcagcggacaacatggggcaaggttacaactgtgctgcagactggtagtccaggcattggtggactcccagctaaggcaatgctgcagaaaatgcgaatgtttagtacgtactttgaggagatatacgcagcgcagtcggaatgggtgatagcagatgaccagctaagggtggacattagggcagcagtggaggagacagtgatgccagtttacgcctctttaattgccaagttgaagtcttctcctgaaactgggcgggatt

SEQ ID NO: 1607 - DNA, 239 bp, Zea mays
ggttacaactgtgctgcagactggtagtccaggcattggtggactcccagctacaggcaatgctgcagaaaatgcgaatgtttagtacgtactttgaggagatatacgcagcgcagtcggaatgggtgatagcagatgaccagctaagggtggacattagggcagcagtggaggagacagtgatgccagtttacgcctctttaattgccaagttgaagtcttctcctgaaactgggcgg

SEQ ID NO: 1608 - DNA, 227 bp, Zea mays
ggactcccagctaaggcaatgctgcagaaaatgcgaatgtttagtacgtactttgaacgagatatacgcagcgcagtcggaatgggtgatagcagatgaccagctaagggtggacattagggcagcagtggaggagacagtgatgccagtttacgcctctttaattgccaagttgaagtcttctcctgaaactgggcgggatttgtacatcaaatacactccagagg

SEQ ID NO: 1609 - DNA, 414 bp, Zea mays
  unsure (1)..(414): unsure at all n locations
gccacgcgtncgattgggcaagggtacaactgtgctgcaaagtggcactccaggcattggtggactcccagccaaggcaatgctgcagaaactgcgaatgtttaatacatattttgaggagatctatgcggcacagtcagaatgggtgatagcagatgaccagctaaaggttgacattagggcagcggtggaggagacagtgatgccagtttacgcctctttaattgccaagttaaagtcttctcctgaaactgggcgtgatttgtacatcaaatacaccccagaagatgttgtaacccacatccagcacttggtttgaagaacaacaaagtgataaatgatatgtatccttgtagcctgttatactgcagcttctgctcttctgaacttgtgaagttgctaccatggatttct

SEQ ID NO: 1610 - DNA, 360 bp, Zea mays
gtgatccatctcttgcttctatcttcttgatgaataatggcaagtacatcatacacaaggtgaatgacagtgagttgggtgttttactcggtgatgagtggataaagcagatgacaaatagagttcgacgctggagcatggattatcagcgggcaacatggggcaaggttacaactgtgctgcaaagtggtactccaggcattggtggactcccagccaaggcaatgctgcagaaactgcgaatgtttaatacatattttgaggagatctatgcggcacagtcagaatgggtgatagcagatgaccagctaaaggttgacattagggcagcggtggaggagacagtgatgccagtttacg

SEQ ID NO: 1611 - DNA, 286 bp, Zea mays
aagaaatgtaggcagctaagacaccaggaatccagaggagaaagccaaatgagtattgacaaaacccgtgctgttgtgaaggatttgcactccagaattttagtggccattcagagaatcgacatgatttcgaagaacatagaggatcttagagacaaagagcttcaaccacaactagaggaattaattggaagtttgactcgcatgtgggcaacaatgcttgagtgtcaccggcatcaacacgatatcattaaactagtatccagcactcgcaacatgaagacct

SEQ ID NO: 1612 - DNA, 288 bp, Zea mays
ctcaacgtgctgaatgttttataagcatgtaaattgctccatttagaggtgattaaacgtatcagaaaagagtatgaggaacttctatcaaagaataattcactaaaggaaaaacttgaaggcaaacaacacaaaactgatgaggcaggacttaacaacaagctgcaacattctggcaatgacatccagcgtaaaggatactaatcgagctatcatgcaatgcttgcatagcatggccctaactagattattgggatgcgcaattgtagtatgcgtgttaactcctta

SEQ ID NO: 1613 - DNA, 280 bp, Zea mays
ctcaacgtgctgatgttttaaagcaggaaaatgcttcacttagagatgaagtaaaccgtatcagaaaagagtatgaggaacttctatcaaagaataattcactaaaggaaaaacttgaaggcaaacaacacaaaactgatgaggcaggacttaacaacaagctgcaacattctggcaatgacatccagaaaaaaggaaactaatcgagctatcatgcaatgcttgcatagcatggccctaactagattattgggaggcgcaattgtgtatgcgtgtaact

SEQ ID NO: 1614 - DNA, 317 bp, Zea mays
ggccgccgagcgggtcgcacatgcggacctctccctcgacgccgccttcttcgacggcctctcgctgcagggaggcggcggcggcgggggggtaagagggggcgtggcggggcacaagaggagcggctccatggacggggacacctcgccgttcgagggcgagtcggcgccgccgtccgtgctgccggactacgccaagaaggccgtgcccgacgacaagctcgccgagctcgcgctcctcgatcccaagcgcgccaagaggatcctggcgaaccggcagtccgcggcgaggtccaaggagaggaagatcaagtaca

SEQ ID NO: 1615 - DNA, 334 bp, Zea mays
cccacgcgtccggaaaattacagatttagttaccaaacagcagcaaatggatgctgaacgtgatcatgcgaagtcagagttggaacaatttaaggctgacattgccagggctatgaagcaaagggggtcacttgagaaagcccttgtcaagaaggaaaaatcacttaacaacatctgcaaccaaattgagcaagtccagtctagcattgcaatgaagaatgatgaaatgggcacagagcttattgatcagctaacttcagaagaaagagatctcctttcacgattgaatcctgaaattactgatttgaaggagagatttctaatgtgtaaaaca

SEQ ID NO: 1616 - DNA, 328 bp, Zea mays
gaagtgaaggctggtgagattatgaagcttgagtatcagaggaaggttgctttgttaaatagacaaaagaaacacaatgctgccattgaggttcttgagaaaacgaaagctgcggtaacccacttacatactagatacatagttgatatgcaatcaatggattcaactgtgtcagaaattcagtatctccgtgataaccaactgtacccaagactattggatcttactgaccggatggcaaaaatgtgggaggacatgaagatacatcacgcaaatcagctgaaaattgtcctaaatctgaagtctgttgatattcctgattccaata

SEQ ID NO: 1617 - DNA, 288 bp, Zea mays
ggagaaaaagctctatgatgaagtgaaggctggtgagattatgaagcttgagtatcagaggaaggttgctttgttaaatagacaaaagaaacacaatgctgccattgaggttcttgagaaaacgaaagctgcggtaacccacttacatactagatacatagttgatatgcaatcaatggattcaactgtgtcagaaattcagtatctccgtgataaccaactgtacccaagactattggatcttactgaccggatggcaaaaatgtgggaggacatgaagatacatca

SEQ ID NO: 1618 - DNA, 274 bp, Zea mays
acaggaacaagatggagacgtacgaagttcccagaatggtgcatcacgttctccatctgagggaaaatttaaccaagctatggcaatcatgcccatgccatcaagtggcccagtaactggtccaactacaaacctgaatattgggatggactattgggccaacacggcaagctctgctcctgtaattcatggcaaagtgaccccaacaacagttccaggggctgtggtcccagcagagcaatggatacaggctgaacgtgaactcaaaaggcaa

SEQ ID NO: 1619 - DNA, 117 bp, Zea mays
cttctcgaagtggcgacagtggcagtgacagttcaagcgaagggagtgaaggagattctcgataatgattcatgacaagcataagtggggacaggaaccaggattggagacgttacg

SEQ ID NO: 1620 - DNA, 374 bp, Zea mays
gtgagcgtccctatgtgaccgcgttttcgacggcctcgcccccttcggcgatctcgccttcatcgccgccgtgcgtacccaggctctgcagctcatatcgttcggtgacgctatctcttcctcaagccgctcgccggagcgcctcttccgcgtcgttgacatgtacgaggctgtgcgtgacattctccctgaccttgatcctgtgttctctgacccatactctgctgcactccatgcggaggtctccgccatgtgcaacacactggggtcctctatcaaaggtacacctatggagttggaaaatctcatccgccgtgaccctgcccgagttgctgcccaaggtggtgccatacatcctatcactcggtatgtat

SEQ ID NO: 1621 - DNA, 280 bp, Zea mays
gatcatcgccgcatacctcatgccccccatcgagtctggctcggttgatttcgccgaatttgagccccggctcgtttactgattctgtacaaagatttatccttgagttattcaccctgaaagacaagctgctggtgctttctgccgaaggggccttgaatgaatggtgaaaaccgctggatggttagaggatctgcatcttcttgtgttcttctgtaaaataatgagacttgggcagcataaaaagcttggcaaatttctgttgtgtggcatctccatg

SEQ ID NO: 1622 - DNA, 445 bp, Zea mays
gcgcagagaaactctttgttctgttagacatgtacgagataatgtgcgagcttcaaacagagattgataccatggtcgttggagaatcaggttcgcaaatgcgcgactctgcactgagtttaacaaaatgcttagcacaaacagcacaaaagactttcagtgattttgaagaagctgttgaaaaggatgcaacaaagaatattcatactgatggaacagttcatcctttaacaagctatgtgatcaactatgttaagtttttgtttgactaccagtcaactctaaagcagcttttccaggagttcaaggaagatgggacaggttctgagctggcagctgtaacaatgaaaatcatgcaagccttacaaaataatttagaagcaaaagcaaaacaatacaaggatcctgcattgatgcacatatttttgatgaataacattcacta

SEQ ID NO: 1623 - DNA, 275 bp, Zea mays
  unsure (1)..(275): unsure at all n locations
gctaagtccctgccccctctctttttcttacattcaggtcctcgcagctcctctcttttttcttgtttctttctttcgatctgcgagctgtccaggtccagtactctcctttccgtgaaggaactcttgcagccggcccctctggtttcctcgaattcttgttccccggtccctcctcctgttcccgcgtagatccgtccgtccgatgagcacaccttacccaaccccatgnttacccaccagttcctctgatggctgccgtgctccgatgaagc

SEQ ID NO: 1624 - DNA, 250 bp, Zea mays
ccggataaaagataaggagtgtctctcctttgccatcctcctctctttcagctaagtcccttccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgtgtcccggtccctcctcctgtcgccgcgtagatccgtccgtcc

SEQ ID NO: 1625 - DNA, 123 bp, Zea mays
accagttcctctgacggccgccgtgctccgatgaagctgagcgtgctccgtatccgctgctcgcactccttctccgtcgccttcctctactggttctacgtcttctcatgaacgcatctcccc

SEQ ID NO: 1626 - DNA, 207 bp, Zea mays
atgataaggagtgtctctcctttgccatcctcctctctttcagctaagtccctgctccctctctttttcttacattcaggtcctcgcagctcctctcttttttcttgtttctttcgatctgcgagctgtccaagtccagtactcttctttccctcaaggaactcttgcagccggcccctctggtttcctcgaattcatgttccccgg

SEQ ID NO: 1627 - DNA, 229 bp, Zea mays
  unsure (1)..(229): unsure at all n locations
ctccggataagagataaggagtgtctctcctctctttcagctaagtcnctggcccctctctttttcttacattcaggtcctcgcagctcctctcttttttcttgtttctttctttcgatctgcgagccgtccaggtccagtactctcctttccgtgaaggaactcttgcaggcggcccctctggtttcctcgaattcttgtgccccggtggctcctcctgtcgccgcgt

SEQ ID NO: 1628 - DNA, 382 bp, Zea mays
gtattcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccacctgctgatccttcgccgtctctctctctctctctctctctctctctcttagatagtcttttgaatccatctctagggctcttgtttctcgccatcctcaccgcaccccaccccgcaccaaacagattcaatccgacaagacaagcatcgatgtcgtc

SEQ ID NO: 1629 - DNA, 416 bp, Zea mays
aagataaggagtgtctctcctttgccattctcctctctttcagctaagtccctgccccgtgtctttttcttacattcaggtcctcgcagctcctctcttttttcttgtttctttcgatctgcgagccgtacaagtccagtactcttctttccctcaaggaactcttgcagccggcccctctggtttcctcgaattcttgttccccggtccctacttctgtccccgcgtagatccgtccgtccgaggagcacaccgtgcccacccccatgtttacccaccagttcctctgacggacgccgtgctccgatgaagctgagcgtgctccgtatccgccgttcccactccttctccgtcgccttactttactgggtctacgtcttctcatgaacgcattggccctcttcaactgctgatcc

SEQ ID NO: 1630 - DNA, 436 bp, Zea mays
ggagtgtctctcctttgccatcctcctctctttcagctaagtccctgccccctctcgtgttcttacaggcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccaactgctgatccttcgccgtctctccctctctctttctc

SEQ ID NO: 1631 - DNA, 215 bp, Zea mays
gcacgaggctgcccaaggtggcgtcatacatcctatcactcggtatgttatgaactatctccgagctgcgtgtggatcgcggcagacattggaagaggtgatggaaggtgactttggggctaatggaggtgcgcctgtggctgttgatcctgaccgtcccacatcatcccttgctgtgcacattgcttggatcatggatgttcttcaaaagaatc

SEQ ID NO: 1632 - DNA, 286 bp, Zea mays
tctcatccgccgtgaccctgcccgaattgctgcccaaggtggcgtcatacatcctatcactcggtatgttatgaactatctccgagctgcgtgtgggtcgcggcagacattggaagaggtgatggaaggtgactttggggctaatggggtgcgcctgttgctgttgatcctgaccgtcccacatcatcccttgctgtgcacattgcttggatcatggatgttcttcaaaagaatctggatatgaagtctaagatctaccgtgatccatctcttgcttctatcttct

SEQ ID NO: 1633 - DNA, 182 bp, Zea mays
  unsure (1)..(182): unsure at all n locations
cccacgcgtccggtgccatacatcctatcactcggtatgttatgaactatctccgtgctgcgtgtgggtcgcggcagacattggaagaggtgatggaaggtgactttggtgttaatagaggtgcgcctngtggctgttgaccctgaccgccccacatcatcccttgctgtgcacatcgcatg

SEQ ID NO: 1634 - DNA, 304 bp, Zea mays
gaaaaacttactaaagatgatgtacaaaaaatgcaatgggaggctttggaggctaaaattggaaactggatacattttatgcgaatcgcggtcaaattattactagcaggggaaagacaaatctgtgatcagatttttgatggtgtgaattttaacaagggccattgttttgctgaactcacagcaaatagtattataactcttttcagctttggagacgctgttgctaaaagcaaaaggtctcctgaaaagctgtttgtgttgcttgacatgtatgaagtaatgcgtgaacttcaaccagaga

SEQ ID NO: 1635 - DNA, 261 bp, Zea mays
atcgcggtcaaattattactagcaggggaaagaaaaatctgtgatcagatttttgatggtgtgaattttaacaagggccattgttttgctgaactcacagcaaatagtattataactcttttcagctttggagacgctgttgctaaaagcaaaaggtctcctgaaaagctgtttgtgttgcttgacatgtatgaagtaatgcgtgaacttcaaccagagatcgatgaaatatttgaaggcaaaccttgcactgagatgcgg

SEQ ID NO: 1636 - DNA, 334 bp, Zea mays
  unsure (1)..(334): unsure at all n locations
ctgcacgcagctatagctcgcataattaactcatgggtgcatagagatatgccgccgacgacccatatctatgggtccgtccccttgcactgcatcttcttcttcctcctnctcgacctccttcaattattcctagcgtttgcttctcccttccttgacctttgcttggaaccatcgatagttacttattgggcatggagcacgtcatctcaatgcaggagatcctcgggcccttctgggagctgctgccagcgccagcgccagatccagagccggagcagcctccggtaaccggcatcgtcgtcggcagtgtcatagacgttgctgctgctgg

SEQ ID NO: 1637 - DNA, 294 bp, Zea mays
cggacgcgtggggtcaccgacgaccccatgctccgcccctggcagccgtccttccccccgatgcagcccatcgggttctgagaatctgagcctcagccggcggaagagagccaatttctgtcgtcgtgccgctgtctatctcgtattggtatatctattcataaatcatccttgtcatggtttgctcttcttgtcagtgttataaatttgcttcttgttagtgttataaatttggccatcggaaaggatgtgtttgtagttgtaatatcttgtttggagttgtaatatcttatc

SEQ ID NO: 1638 - DNA, 237 bp, Zea mays
cccacgcgtccggagaatctgagcctcagccggcgggagagagccaatttctgtcgtcgtgccgctgtctatctcgtattggtatatctattcataaatcatccttgtcatggtttgctcttcttgtcagtgttataaatttgcttcttgttagtgttataaatttggccatcggaaaggatgtgtttgtagttgtaatatcttgtttggagttgtaatatcttatcttgcttatga

SEQ ID NO: 1639 - DNA, 231 bp, Zea mays
gccaatttctgtcgtcgtgccgctgtctatctcgtattggtatatctattcataaatcatccttgtcatggtttgctcttcttgtcagtgttataaatttgcttcttgttagtgttataaatttggccatcggaaaggatgtgtttgtagttgtaatatcttgtttggagtcttaatatcttatcttgcttatgaaatcgaatatgcctatatatatatatgttatgctgt

SEQ ID NO: 1640 - DNA, 229 bp, Zea mays
ggcaagggagagtgtgaagattgagcatgagaaaaagctttctactctgcagagcctggaatacaaagggagggatagtgcaaagctggataagaccaaggcctccataaacaagctgcaatcactgattgttgttacctctcaggctgccacaactacatcatcagccatcgttagagtccgtgacaatgagcttgcaccacagcttgttcagctctgttttgcgcta

SEQ ID NO: 1641 - DNA, 262 bp, Zea mays
ggcgagagagagtgtgaagattgagcatgagaaaaagctttctactctgcagagcctggagtacagagggagggatagcgcaaagctggacaagaccaaggcctccataaacaggctgcaatccctgatcgtagttacgtcacaggctgccacaaccacatcatcagccattgttagagtccgtgacaatgagcttgcaccacagcttgtccagctctgttttgcgctactgggcatgtggaggtcaatgaaccatttccac

SEQ ID NO: 1642 - DNA, 255 bp, Zea mays
gtggaggtcaatgaaccatttccacgagatacaaaacgagattgttcagcaagtccgcggcctggtggacaactccatggccgagtcaacatccgacctccacaggcttgcgactcgtgatctcgaggccgctgtcgcggcatggcactcgaacttcaaccgcctcatcaagtaccaacgcgactacatccgctctctgtacggctggctgaagctcacgctctgccaggtggacagcagcgtgccccaggaagc

SEQ ID NO: 1643 - DNA, 265 bp, Zea mays
gtccgagaagatcgggtactggaggtacatcaccatcttcaggcacctcaaggcgaacccggagtaccaggtgtaccccatcttcaagtacttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgag

SEQ ID NO: 1644 - DNA, 289 bp, Zea mays
agatcgggtactggaggtacatcaccatcttcaggcacctcaaggcgaacccggagtaccaggtgtaccccatcttcaagtacttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacat

SEQ ID NO: 1645 - DNA, 281 bp, Zea mays
caaagaattcgacatgcatgtgatcatcgagaccaaccgcacaacggcgaggatcttccctgctgtcctagacgtcgagaacccagagttcaagaggaagcttgacaggctggttgagatcaaccagaagatcattgccgtcggagagtccgacgaaatccccctagtgaagaacctgaagaggattcctcttgtcgcctctctggtgtccgagatcatcgccgcctacctcatgccccccatcgagtctggctcggttgatttcgccgaatttgagcccc

SEQ ID NO: 1646 - DNA, 311 bp, Zea mays
ggccgccgccgacaggatggagggcccgctccgccagatcttcgtagagttcctcgagcgctcctgcaccgccgagttctccggcttccacctctacaaggagctcggccgcagctcaagaaaaccaacccggtcgtggcggagatcttctcgctcatgtcaagggacgaggcgcgccatgctgggttcttgaacaaggggctgtctgacttcaacttggcgctggacctggggttcctgaccaaggctaggaagtacaccttcttcaagcccaagttcatcttctacgccacctacctgtccgagaagat

SEQ ID NO: 1647 - DNA, 317 bp, Zea mays
  unsure (1)..(317): unsure at all n locations
ggcagagaagaagtcgccgtgctcaaggctcagccgcagttcctcaatgactggaaggccaagctctggtcacggttcttctgcctctcggtacatggtcacatacaccgagacgcagaagaaccgtgaccagagcttggccttctgcctctcggtgtatgtgaccatgtacctgaatgactgccaacgcactgcattctatgagggaattggtctggacatcaaagaattcgacatgcatgtgatcatcgagaccaaccgcacaacggcgaggatcttccctgctgtcctagaccccgaganacccgagttcaaga

SEQ ID NO: 1648 - DNA, 226 bp, Zea mays
gtgaccatgtacctgaatgactgccaacgcactgcattctatgagggaattggtctggacaccaaagaattcgacatgcatgtgatcatcgagaccaaccgcacaacggcgaggatcttccctgctgtcctagacgtcgagaaccccgagttcaagaggaagcttgacaggatggttgagatcaaccagaagatcattgccgtcggagagtccgacgaaatccccc

SEQ ID NO: 1649 - DNA, 209 bp, Zea mays
ggacgaggcgcgccatgctgggttcttgaacaaggggctgtctgacttcaacttggcgctggacctggggttcctgaccaaggctaggaagtacaccttcttcaagcccaagttcatcttctacgccacctacctgtccgagaagatcgtgtactggaggtacatcaccatcttcaggcacctcagggcgaacccggattaccaggtgt

SEQ ID NO: 1650 - DNA, 270 bp, Zea mays
ccaaagaattcgacatgcatgtgatcatcgagaccaaccgcacaacggcgaggatcttccctgctgtcctagacgtcgagaaccccgagttcaagaggaagcttgacaggatggttgagatcaaccagaagatcattgccgtcggagagtccgacgaaatccccctagtgaagaacctgaagaggattcctcttgtcgcctctctggtgtccgagatcatcgccgcatacctcatgccccccatcgagtctggctcggttgatttcgccg

SEQ ID NO: 1651 - DNA, 312 bp, Zea mays
agtacgcctgagtacggtccggaatccgggtcaccacggccgggacctgggcaacacttagcagggaacagctgcaaactgtgcaacttaaagaagacattgcccgcgcagagactagaaatgcagagctgacgttgagatcaaccagaagatcattgccgtcggagagtccgacgaaatccccctagtgaagaacctgaagaggattcctcttgtcgcctctctggtgtccgagatcatcgccgcctacctcatgccccccatcgagtctggctcggttgatttcgccgaatttgagccccggctcgttta

SEQ ID NO: 1652 - DNA, 179 bp, Zea mays
agtccgagaagatcgggtactggaggtacatcaccatcttcaggcacctcaaggcgaacccggagtaccaggtgtacccctcttcaagtacttcgagaactggtgccaggacgagaacaggcacggcgacttcttctctgccctgctcaaggctcagccgcagttcctcaatgactgga

SEQ ID NO: 1653 - DNA, 164 bp, Zea mays
tgccaagcactgcattctatgagggaattggtctggacaccaaaaattcgacatgcatgtgatcatcgagaccaaccgcacaacggcgaggatcttccctgctgtcctagacgtcgagaacccagagttcaagaggaagcttgacaggatggttgagatcaacc

SEQ ID NO: 1654 - DNA, 155 bp, Zea mays
catgtacctgaatgactgccaacgcactgcattctatgagggaattggtctggacaccaaagaattcgacatgcatgagaacattgagaccaaccgcacaacggcaaggatcttccctgctgtcctagacgtcgagaaccccgaatgcaagagga

SEQ ID NO: 1655 - DNA, 100 bp, Zea mays
agaagatcattgccgtcggagagtccgacgaaatccccctagtgaagaacctgaagaggattcctcttgtcgcctctctggtgtccgagatcatcgccgc

SEQ ID NO: 1656 - DNA, 259 bp, Zea mays
tcgaagatcattgccgtcggagagtccgacgaaatccccctagtgaataacctgaagaggattcctcttgtcgcctctctggtgtccgagatcatcggcgcctacctcatgccccccatcgagtctggctcggttgatttcgccgaatttgagccccggctcgtttactgattctgtacagagatttatccttgagttattcaccctgaaagacaagctgctggtgctttctgccgaaggggccttggatgaatggtga

SEQ ID NO: 1657 - DNA, 295 bp, Zea mays
tgccaacgcactgcattctatgagggaattggtctggacaccaaagaattcgacatgcatgttgggggcgagaccaaccgcacaacggcgaggatcttccctgctgtcctagacgtcgagaacccagagttcaagaggaagcttgacaggatggttgagatcaaccagaagatcattgccgtcggagagtccgacgaaagaacatagtgaagaacctgaagaggattcctcttgtcgcctctctggtgtccgagatcatcgccgcctacctcatgccccccatcgagtctggctc

SEQ ID NO: 1658 - DNA, 180 bp, Zea mays
ggaaggccaagctctggtcacggttcttctgcctctcggtgtatgtgaccatgtacctgaatgactgccaacgcactgcattctatgagggaattggtctggacaccaaagaattcgacatgcatgtgatcatcgagaccaaccgcacaacggcgaggatcttccctgctgtcctagacg

SEQ ID NO: 1659 - DNA, 141 bp, Zea mays
cggagtaccaggtgtaccccatcttcaagtacttcgcgaactggtgccaggacgagaataggcacggcgacttcttctctgccctgctcaaggctcagccgcagttcctcaatgactggacggccaagctctggtcacggt

SEQ ID NO: 1660 - DNA, 109 bp, Zea mays
aagaggcgcgccatgctgggttcttgaacaaggggctgtctgactgtcaacttggcgctggacctggggttcctgaccaaggctaggaagtacaccttcttcaagccca

SEQ ID NO: 1661 - DNA, 289 bp, Zea mays
cgcacaacggcgagtatcttccctatctgtcctagacgtcgagaaccccgagttcaagatgaagcttgacaggatggttgagatcaaccagaatatcattgccgtcggagagtccgatgaaatccccgctagtgaagaacctgaagaggattcgacttgacgcctctcaggtgtccgagatcatcgccgcatacctcatgccccccatcgagtctggctcggtagatttcgccgaatttgagccccggctcgtatactgattcggtacgaagatttatccttgagttat

SEQ ID NO: 1662 - DNA, 266 bp, Zea mays
cgcacaacggcgaggatcttccctgctgtcctagacgtcgagaaccccgagttcaagatgaagcttgacaggatggttgagatcaaccagaagatcattgccgtcggagagtccgacgaaatccccctagtgaagaacctgaagaggattcctcttgtcgcctctctggtgtccgagatcatcgcaccatacctcatgccccccatcgagtctggctcggttgatttcgccgaatttgagccccggctcgtttactgattctgtac

SEQ ID NO: 1663 - DNA, 395 bp, Zea mays
agcctgaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtatttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacatgcatgtgatcattgagaccaacgcacaacggcg

SEQ ID NO: 1664 - DNA, 418 bp, Zea mays
gaacaaggggctgtctgacttcaacttggcgctggacctggggttcctgaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtacttcgagaactggtgccaggacgagaacaggcacggcgactttttctttgacctgctcaaggctcaaccgcagttcctcaatgactggaaaggccagcttttggcaacggtccttttgcctcttgggggatgtgacccatgtaccctgaatgactgccaaacgcactgcatttctatgaagggaattgggtctgggacaccaaaagaatttgacatgcat

SEQ ID NO: 1665 - DNA, 416 bp, Zea mays
ccggcttcctcctctacatggagctcggccgcaggctcaagaaaaccaggccggtcgtggcggagatcttctcgctcatgtcaagggacgaggcgcgccatgctgggttcttgaacaaggggctgtctgacttcaacttggcgctggacctggggttcctgaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtacttcgagaactggtgccaggacgagaacaggcacggcgacttcttctctgccctgctcaaggctcagccgcagttcctcaatgactggaaggccaagctctggtca

SEQ ID NO: 1666 - DNA, 461 bp, Zea mays
  unsure (1)..(461): unsure at all n locations
atggtcttgtgaaccagttcancnatcattctgtacctnctcgaatacccgccgacgcactcgttcgaccactcgtccgcccacgcgtccggttcttgggctgtctgacttcaacctgtcgcggggccttttgttcctgaccaaggctaggaagtacaccttcttcaagcccaagttcatcttctacgccacctacctgtccgagaagatcgggtactggaggtacatcaccatcttcaggcacctcaaggctaacccggaataccaggtgtaccccatcttcaagtacttcgagaactgttgccaggacgagaacaggcactgcgacttcttctctgccctgctcaaagctcaatcgcagttcctaaatgactggaatgccaagctctggtcacggatcttctgcctcttggtgtatgtgaccatgtacctgaatgactgccaacgcactgcattctatg

SEQ ID NO: 1667 - DNA, 427 bp, Zea mays
caggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacatgcatgtgatcatcgagaccaaccgcacaacggcgaggatcttccctgctgtcctagacgtcgagaaccccgagttcaagatgaagcttgacaggatggttgagatcaaccagaagatcattgccgtcggagagtccgacgaaatccccctagtgaagaacctgaagaggattcctcttgtcgcctctctggtgtccgagatcatcgccgcatacctcatgccccccatcgagtctggctcggttaat

SEQ ID NO: 1668 - DNA, 395 bp, Zea mays
acgcgcctcatcaacgccgagatcaacaagcagctcaaccaggcggagttcgacgccctgctacaggagttcaagacagactacaaccagacccacttcgtgcgcaaccccgagttcaaggccgccgccgacaggatggagggcccgctccgccagatcttcgtagagttcctcgagcgctcctgcaccgccgagttctccggcttcctcctctacaaggagctcggccgcaggctcaagaaaaccaacccggtcgtggcggagatcttctcgctcatgtcaagggacgaggcgcgccatgctgggttcttgaacaaggggctgtctgacttcaacttggcgctggacctggggttcctgaccaacgctatgaagtacaccttcttcaagcccaa

SEQ ID NO: 1669 - DNA, 306 bp, Zea mays
acgcggtgaaggaggatgaggttaagatttctgtcccccccgcgccggtcatggggttaccgggcggagcggagggcgtgagtgtgcctggcggcggaggcgggagggaacggaagcggcagcttgtgagtacagtggatcgcgctcgctctgctatccagcgagagatacgaatgataaaaaaccgcgagtctgctgccaggtcacgggagaggaagcaggcctatatcgccgagctagaatacatggtaacgcggctcgcggaggagaaagctgagttgctgagacaacaggaagagcagttcc

SEQ ID NO: 1670 - DNA, 260 bp, Zea mays
cggcggaggaggtgtggaaggagatcactggcggaggtggcagtggggaagccgtggctcccgtggcggctcaggctgtcgctcccgatggtggcgctggcacaggcggcccggaggtgacgctggaggacttcctggccagggagagcgcggtgaaggaggatgaggttaagatttctgtcccccccgcgccggtcatggggttaccgggcggacggagggcgtgagtgtgcctggcggcggaggcgggagggaacgga

SEQ ID NO: 1671 - DNA, 394 bp, Zea mays
cggcggaggaagtgtggaaggagatcactggcggaggtggcagtggggaagccgtggctcccgtggcggctcaagttgtcgctcccgatggtggcgccggcacaagcggcccggaggtgacgctggaggacttcctggccagggagagcgcggtgaaggaggatgaggttaagatttctgtcccccccgcgccggtcatggggttaccgggcggagcggagggcgtgagtgtgcctggcggcggaggcgggagggaacggaagcggcagcttgtgagtacagaggatcgcgctcgctctgctatccagcgagagaaacgaatgataaaaaaccgcgagtctgctgccaggtcacgggagaggaagcaagcctatatcgccgagctagaatacat

SEQ ID NO: 1672 - DNA, 319 bp, Zea mays
ctgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagaaatacaaggacgcttccgttgacaataaaaatctaacagttgatgttgagactatgaggagaaaggtgaacatagccgaggaagctgtcaggaggctaactgggatcaccctcatgctaccgaccgcttttgagaagcccacgagcagcgc

SEQ ID NO: 1673 - DNA, 172 bp, Zea mays
aacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagaaatacaaggatgctt

SEQ ID NO: 1674 - DNA, 338 bp, Zea mays
catggtaccaccttatgggactccaccattaccttatgtgatgtatccacctggagcagtatatgcccatccctctacacctcctactatgcatccgtttagtcattaccctatgccaacaaatggacatgctgaaactcctggaaccgcgccaagtgctccagaaatgaatgggaaaagtgagcctggcagaacatctgctccatctgccaatgggattacctcgcacagtgagagtggaagtgagagtgagagtgaaggaagtgatgccaattatgaaaatgattcacattcaaaggacaatgatggaaaggaagatggcaattctcagaatagca

SEQ ID NO: 1675 - DNA, 232 bp, Zea mays
gcacgagctgatatgagtaaggtgtttgaagacagaacgtttgtgtcatctatccttaattcgcttcctggtgttgatcccaatgatccatctgttaaagatttgctggcatcattgcacagccagggagagcaagagaagaaggaagacaagtcagacaaaacagaagacgagaagaactgatgtagccatgttcatgcttccatgctcacaaagaaattgaacattggtc

SEQ ID NO: 1676 - DNA, 156 bp, Zea mays
cacacgcgtccgagctggtgcagttgaccctgacttagcgttggctcttcaaatgtctgtccaggatgcaaacatgtccagtgacactgatatgagtaaggtgtttgaagacagaacatttgtgtcatctatccttaattcgcctcctggcgcctg

SEQ ID NO: 1677 - DNA, 302 bp, Zea mays
ccttaattcgcttcctggtgttgatcccaatgatccatctgttaaagatttgctggcatcgttgcacagccagggagagcaagagaagaaggaagacacgtcagacaaaacagaagacgataagaactgatatagccatgttcacgcttccatgcgtacaaagaaattaaagaccggtctccattgactgcgtttactctcttggtcgtggagtttgtttatcctcatagaacggtgctttgattataacttaccgccgagggaatttgtattatgacactgcaacaatcttctctccatat

SEQ ID NO: 1678 - DNA, 309 bp, Zea mays
ccttaattcgcttcctggtgttgatcccaatgatccatctgttaaagatttgctggcatcgttgcacagccagggagagcaagagaagaaggaagacacgtcagacaaaacagaagacgataagaactgatatagccatgttcacgcttccatgcgtacaaagaaattaaagaccggtctccattgactgcgtttactctcttggtcgtggagtttgtttatcctcatataacggtgctttgattataacttaccgccgagggaatttgtattatgacactgcaacaatcttctctccatatatgttca

SEQ ID NO: 1679 - DNA, 230 bp, Zea mays
caaagaacaaccaaaggatgatgacgatctactacagcaggcacttgcaatgtcaatggagggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgtttgtgtcatctatcc

SEQ ID NO: 1680 - DNA, 248 bp, Zea mays
aaaaaggctgcagaagatacatctaataccgaaaatatcaatgcctcaagctcaaacagcgattctgttatggctgaagcagaacttgcctcaaatgctgctgctggtgacaagcaagaacagccaaaggatgatgacgatctactacagcaggcacttgcaatgtcaatggagggcggtgcttcaggatctgcagctgtgactgactccgctatggcagaagctggtgcagttgaccctgacttagc

SEQ ID NO: 1681 - DNA, 237 bp, Zea mays
tccagaattggcacttgccctgcggttgtctatggaagaagagcgggcaaggcaagaggctattgcaaaaaaggctgctgaagatacttctaatacagaacataacaatgtcccaagctcaaacagtgattctgttatggctgaaggagaacctgcctcaaatgctgctgctggtgacaaagaacaaccaaaggatgatgacgatctactacagcaggcacttgcaatgtcaatgga

SEQ ID NO: 1682 - DNA, 255 bp, Zea mays
  unsure (1)..(255): unsure at all n locations
caagctcaaacagtgattctgttatggctgaaggagaacctgcctcaaatgctgctgctggtgacaaagaacaaccaaaggatgatgacgatctactacagcaggcacttgcaatgtcaatggagggtggtgcttcaggatctgcagctgtgactgactctgctatggcagaagctggtgcagttgaccctgacttggcattggctcttcaaatgtctgtccgnagatgcaacatgtccagtgacactgatatga

SEQ ID NO: 1683 - DNA, 264 bp, Zea mays
tcaatgcctcaagctcaaacagcgattctgttatggctgaagcagaacttgcctcaaatgctgctgctggtgacaagcaagaacagccaaaggatgatgacgatctactacagcaggcacttgcaatgtcaatggagggcggtgcttcaggatctgcagctgtgactgactccgctatggcagaagctggtgcagttgaccctgacttagcgttggctcttcaaatgtctgtccaggatgcaaacatgtccagtgacactgata

SEQ ID NO: 1684 - DNA, 291 bp, Zea mays
cctgcctcaaatgctgctgctggtgacaaagaacaaccaaaggatgatgacgatctactacagcaggcacttgcaatgtcaatggagggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgtttgtgtcatctatccttaattcgcttcctggtgttgatcccaatgatcca

SEQ ID NO: 1685 - DNA, 283 bp, Zea mays
cagaacgtttgtgtcatctatccttaattcgcttcctggtgttgatcccaatgatccatctgttaaagatttgctggcatcattgcacagccagggagagcaagagaagaaggaagacaagtcagacaaaacagaagacgagaagaactgatgtagccatgttcatgcttccatgctcacaaagaaattgaacattggtctgcattggctgcgcttactctcttggctatgaaatttgcttatcctcatgtaacagtgctttgtttataacttaatgccgagg

SEQ ID NO: 1686 - DNA, 259 bp, Zea mays
agcgattctgttatggctgaagcagaacttgcctcaaatgctgctgctggtgacaagcaagaacagccaaaggatgatgacgatctactacagcaggcacttgcaatgtcaatggagggtggcgcttcaggatctgcagctgtgactgactccgctatggcagaagctggtgcagttgaccctgacttagcgttggctcttcaaatgtctgtccaggatgcaaacatgtccagtgacactgatatgagtaaggtgtttg

SEQ ID NO: 1687 - DNA, 292 bp, Zea mays
agacagaacgtttgtgtcatctatccttaattcgcttcctggtgttgatcccaatgatccatctattaaagatttgctggcatcattgcacagccagggagaggaagagaagaaggaagacaagttagacaaaacagaagacgagaagaactgctcaagctggagtgatgtcgctgtggtgcttttgtgactgatcatctctggagcttttgtgaatgatctagctagctatctgtaattgatctagttgtgaatgatattataattgtgatacttttgtgaatatataatt

SEQ ID NO: 1688 - DNA, 283 bp, Zea mays
gagggcggtgcttcaggatctgcagctgtgactgactccgctatggcagaagctggtgcagttgaccctgacttagcgttggctcttcaaatgtctgtccaggatgcaaacatgtccagtgacactgatatgagtaaggtgtttgaagacagaacgttcctgtcatctatccttaattcgcttcctggtgttgatcccaatgatccatctgttaaagatttgctggcatcattgcacagccagggagagcaagagaagaaggaagacaagtcagacaaaacag

SEQ ID NO: 1689 - DNA, 97 bp, Zea mays
gaagacagaacgtttgtgtcatctatccttaattcgtttcctggtgttgatcccaatgatccatctgttaaagatttgctggcatcattgcacagcc

SEQ ID NO: 1690 - DNA, 273 bp, Zea mays
gggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgtttgtgtcatctatccttaattcgcttcctggtgttgatcccaatgatccatctgttaaagatttgctggcatcgttgcacagccagggagagcaagagaagaaggaagacacgtcaga

SEQ ID NO: 1691 - DNA, 284 bp, Zea mays
gggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgttcgtgtcatctatccttaattcgcttcctggtgttgatcgcaatgatccatctgttaaagatttgctggcatcgttgcacagccagggagagcaagagaagaaggaagacacgtcagacaaaacagaag

SEQ ID NO: 1692 - DNA, 337 bp, Zea mays
tgtccaagctcaaacagtgattctgttatggctgaaggagaacctgcctcaaatgctgctgctggtgacaaagaacaaccaaaggatgatgacgatctactacagcaggcacttgcaatgtcaatggagggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagacgtttgtgtcatctaccttaagcgcttcctggtgttgacccaatgatccactgttaag

SEQ ID NO: 1693 - DNA, 430 bp, Zea mays
  unsure (1)..(430): unsure at all n locations
ctgcggttgtctatggaagaagaacnagnaaggcaagaggctattgcaaaaaaggctgcanangatacatctaataccgaaaatatcaatgcctcaagctcaaacagcgattctgttatggntgaagcanaacttgcctcaaatgctgctgctggtgacaagcantaacagccaanggatgatgacgatctactacagcaggcacttgcaatgtcaatgganggcggtgcttcaggatctgcagctgtgactgactccgctatggcagaagctggtgcagttgaccctgacttaacgttggctcttcaaatgtctgtccaagatgcaaacatgtccacttgacactgatatnantaanggtgtttgaatacanancatttgtgtcatctatccttaattcgcntcctggtgttgattccaatgatccatc

SEQ ID NO: 1694 - DNA, 352 bp, Zea mays
  unsure (1)..(352): unsure at all n locations
atttcggaaatntcaattcctccagctcatactngggattctgttatggctgacgccgaacttgcntcanatgctgctgctggtgncangcgtgaacagncaacggatgatgncgatctactacagcangcacttgcaatgtcaatggncggcggtgcttcaggatctgcngctgtgactgactccgctatggcagangctggtgcagttgaccctgacttaacgttggctcttcanatgtctgtccaagatgcaaacatgtccantgacactgatntgagtaangtgtttgaagacagatcattgtgtcatctatccttaacttcgcctcctggngttgctccaatgattc

SEQ ID NO: 1695 - DNA, 446 bp, Zea mays
gaacgtttgtgtcatctatccttaattcgcttcctggtgttgatcccaatgatccatctgtggaagatttgctggcatcgttgcacagccagggagagcaagagaagaaggaagacacgtcagacaaaacagaagacgagaagaactgatgtagccatgttcacgcctccatgcgcacaaagaaattgaagaccggtctgcgtttactctcttggtcgtggagtttgtttatcctcatataaccgtgctttgattataacttaccgccgagggaatttgtattatgacgctgcaacaatcttctctccatatatgttcaagggattttcgtgtttcaatgctctccaaaaaaaaacaacatccctaaagatatctaagcttacatacctcaatttacaacaaaaaaaaggggcgccgctcgcgatctctaagtctagatcgcgagc

SEQ ID NO: 1696 - DNA, 378 bp, Zea mays
ctggatttgaactccgcgtgcacccaaatgaagatccctagctagcacttgtcctggggtcgactatgcaaacaaaaccagcaacgccagaggctattgcaaaaaaggctgcctaagatacatctaataccgaaagcatcaatgcctaaagctcaaacagcgatactgttatcgctgaatcataacttgcctgaaatgctgctgctgttgacaagcaagaacagtcatacgatgatgactatgtactacagcaggcactagcaatgtcaatggacggcggtgctgtatgatctgcaactgcgactgactccgctatggcacaagctggtgcatctgaccctgacttagcgttggctcttcaaatgtctgtccaggatg

SEQ ID NO: 1697 - DNA, 411 bp, Zea mays
ggccagttgtgccttactcccctacgaacatctgcttgtacgcactgctggagcagcatccgtcaggatatggttaaatgagcacgggctatttgaacttgcacatggcgacaagaccgccgatgattctataccgatggtgctgaaaataccgcgcatgtttgatccatgtcgtggatacagcatcattggctttggtgatatccttcttcctggtcttttagctgctttctgagctaaaatacgatttttctgcaaagaatggcttacggactgcttacagccagtgggcaaaggtggcctatggctctggactactaatcacatatgtagccctgaacctaatggatgggcatggacaacgtgcccttttgtacatcgtgcccttcactcttggcacattgatcgcgc

SEQ ID NO: 1698 - DNA, 457 bp, Zea mays
ctcaaggtgggttcggttctttttggctgtttcttcctgtatgatatcttctgggtgtttagctccaagagatggtttcatgagagcgtgatgattgtggttgcgcgtggcgacaagaccgacgaggatggtgtgcccatgctgctaaaaatcccgcgcatgtttgatccatggggtggatacagcatcattggctttggtgatatccttcttcctggtcttttagttgctttctcgctaagatacgatttttctgcaaagaagggcttacggtctggttactttttgtgggcaatggtggcctatggctctggacttctaatcacatatgttgcgctgaacctgatggatgggcatggacaacctgcccttttgtacatcgtgcccttcactcttggcaccttgatcgcgcttggatggaagagaggggagctgcagaacctgtgggcgaggggag

SEQ ID NO: 1699 - DNA, 353 bp, Zea mays
gccttcctgtatgatatcttctgggtgtttatctccaagagatggtttcatgagagcgtgatgattgtggttgcgcgtggcgacaagaccgacgaggatggtgtgcccatgctgctaaaaatcccgcgaatgtttgatccatggggtggatacagcatcattggctttggtgatatccttcttcctggtcttttagttgctttctcgctaagatacgatttttctgcaaagaagggcttacggtctggttactttttgtgggcaatggtggcctatggctctggacttctaatcacatatgttgcgctgaacctgatggatgggcatggacaacctgcccttttgtacatcgt

SEQ ID NO: 1700 - DNA, 373 bp, Zea mays
gtcttctcatgaacgcatcgcccctctccacctgctgatccttcgccgtctctctctgtctctctctctctctctcttagatagtcttttgaatccatctctagggctcttgtttctccccatcctccccccaccccaccccccaccaaacagattcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctggtggcggaggtggcccgcctgcaggcggagaacgcggcgacgcaggcccgcaccgcggcg

SEQ ID NO: 1701 - DNA, 395 bp, Zea mays
  unsure (1)..(395): unsure at all n locations
catctctagggctcctgtttctccccatcctccccccaccctaccccgcaccaaacgggttcaatccgacatgacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctgttggcggaggtggcccgcctgcaggcggagaacgcggcgacgcaggcccgcaccgcggcgctggaacgcgacctgngcagggtggacggcgacaacgctgtgctgcgcgcccgccacgccgagctgaccggccgcctgcagtcactgggcggcgtcctcgaagtgctccagatggcc

SEQ ID NO: 1702 - DNA, 293 bp, Zea mays
caaagaacggtttaagtctttcaatacacaattcgaagagcttcacgcgaagaatcacaatggatcgtacctgatcaagaactacgagaatccttgaggctcgctgtagccgaagtcctgttgccagcctaccgatcttttatcaaacgctttggcaatcttgtggacaacaacaagaacccgcagaagtacgtgcggtacagcccagaagcagtggaccaacttctaggccagttcttcgaagggcagcaatgggcggagcaaaagcgctgagcaacatagagtgagagtga

SEQ ID NO: 1703 - DNA, 440 bp, Zea mays
  unsure (1)..(440): unsure at all n locations
cccacgcgtccgcgaagagcttcacgcgaagcaatcacaatggatcgtacctgatcaagaactacgagaatccttgaggctcgctgtagccgaagtcctgttgccagcctaccgatcttttatcaaacgctttggcaatcttgtggacaacaacaagaacccgcagaagtacgtgcggtacagcccagaagcagtggaccaacttctaggccagttcttcgaagggcagcaatgggcggagcaaaagcgctgagcaacatagagtgagagtgacggcatgagtacagccagatgccagtaagttcaacagcacagatttcttccgaagcaaccaccagttccttctcgcactacatataatatatagtgacataaacgtctgctgtgcaagcactacctagttntcttttctcagaaaaagcgcgcctaagtttcttttc

SEQ ID NO: 1704 - DNA, 328 bp, Zea mays
tgagacaacaaagcaatttgttgtctctttcttaggagctggcgagtactcggcatggcagatgctagttcaaggaatgacacctcgactgttttagacatggatgataagaatcaaaggttagaaaatggacagagtggagctatggccctggcttcgaattcatctgatcggtctgacagatctgacaaacctatggaccaaaaggttttacgacggcttgcccaaaatcgtgaggcagcaaggaaaagtcggctgaggaaaaaggcatatgtgcaacaactagagagcagcaagctaaaacttgcaagcctggagcaagaactcc

SEQ ID NO: 1705 - DNA, 247 bp, Zea mays
gcgaatcacctcgagcctctaactgagcagcaaatgctgggtttgaccaacctccagcaatcttcccaacaagcagaggatgcgttgtcacagggcatggaagcactgcagcaatctttggcagagactttggctggatctctcggtccagcaggttcttcaggaaatgtggcaaactacatgggtcagatggccatggccatgggcaaactcgggacgctagagaattttcttcgccaagccgaca

SEQ ID NO: 1706 - DNA, 160 bp, Zea mays
gtcacagggcatggaagcactgcagcaatctttggcagagactttggctggatctctcggtccagcaggttcttcaggaaatgtggcaaactacatgggtcagatggccatggccatgggcaaactcgggacgctagagcattttcgtcgccaagccgac

SEQ ID NO: 1707 - DNA, 429 bp, Zea mays
cccacgcgtccggtggcaaactacatgggtcaaatggccatggctatgggaaaacttggaacgcttgagaatttccttcgtcaggctgacaacctgcggctgcagactctacaacagatgcaaaggatcctgaccactagacagtcagctcgggcgctacttgtgataagtgattactcttcacgtctccgtgccctaagctctctctggcttgctcggcccaaggaatagcaagaacatgctatttgactgcaatacttttcacaatttggttttcaatggtcaggagatttgacaaggctgcgacagacttgattcggacatatctgcacatactatgacccaaatggaaggggatgttcatgtagcttaagctgcttagctttgtagttaagtgttgttgatgtatcattaccaactgctgtaaaa

SEQ ID NO: 1708 - DNA, 433 bp, Zea mays
atctatcacattgcaggtcaaatgactaggtctcgtgggtcgacccaagcctctacaatatctcgtatcatcacagatcatccacagagaccatcttccgtgtaagagacaagagagtgggagagaggggggatatatggcagacatcgcgttgctggtgacggagcagttcgacaagaagctgaagcgaggcgcccccggcgaggacatcggcggcggcgccggcgaatataggaggaacttcggggccgtggccaaggtgtggagctcgtgggtggagtccgccgccgccgcgtccggggtgaggttcagcgtcgcggtgcacctggagcccaagaccgcgctcgccctggccgccgccgacggcctcttctccgcctagctagctagctagctactagtgtcgcctagctgcttccaggcccttctcctg

SEQ ID NO: 1709 - DNA, 407 bp, Zea mays
  unsure (1)..(407): unsure at all n locations
agatcatccacagagaccatcttccgtgtaagagacaagagagtgggagagaggggggatatatggcagacatcgcgttgctggtgacggagcagttcgacaagaagctgaagcgaggcgcccccggcgaggacatcggcggcggcgccggcgaatataggaggaacttcggggccgtggccaaggtgtggagctcgtgggtggagtccgccgccgccgcgtccggggtgaggttcagcgtctcggtgcacctggagcccaagaccgcgctcgccctggccgccgacgacggcctcttctccgcctagctagctagctagctactagtgtcgcctagctgcttncaggcccttcttctgagtgagcatcagtagtcgagttcttctggaccatataatacaatgcgc

SEQ ID NO: 1710 - DNA, 349 bp, Zea mays
gcaacggaagcaagaacaccttgacgacctcacctcacaggtaaatcagctgaaggaccagaacaagcagctcagcatggcactgagtataaccagccaaaaccttgtggcagtgcaagcgcagaactctgttctgcagacccagaagatggagctggacagcaggctgggtgccctgacggagatcctctggtacatgaactcaagcaccagcaccagcactgctcctacaaatccagccatagcgaacgacttcacagcatggagcagagcctctgatattcttggtaggaacagctacagcgccatagagctgtaccaatgcttctagctctaagctctagctcta

SEQ ID NO: 1711 - DNA, 340 bp, Zea mays
gcaacggaagcaagaacaccttgacgacctcacctcacaggtaaatcagctgaaggaccagaacaagcagctcagcatggcactgagtataaccagccaaaaccttgtggcagtgcaagcgcagaactctgttctgcagacccagaagatggagctggacagcaggctgggtgccctgacggagatcctctggtacatgaactcaagcaccagcaccagcactgctcctacaaatccagccatagcgaacgacttcacagcatggagcagagcctctgatattcttggtggaacagctacagcgcatagactgtacaatgctctagtctaagctctagtc

SEQ ID NO: 1712 - DNA, 268 bp, Zea mays
attgctgttaaacttctttttgctggggagcgccaactttgcgaccaagtttttgagtgcagtcaatcgttgagagataagtgctatgctgcaataacaaagaacagtttggctacactactcagttttggagaggctattgctatgagtaaacgatcaccagagaaactctttgttctgttagacatgtacgagataatgtgcgagcttcaaacagagattgataccattttcgttggagaatcaggttcgcaaatgcgcgactctg

SEQ ID NO: 1713 - DNA, 227 bp, Zea mays
caagtctgaagaacttgggcgttgaaaaacttagcaaagatgaagtgcagaaaatgccgtgggaaattttggagtctaaaatagggaattggattcatttcatgcgaattgctgttaaacttctttttgctggggagcgccaactttgcgaccaagtttttgagtgcagtcaatcgttgagggataagtgctttgctgcaataacaaagaacagtttggctacacta

SEQ ID NO: 1714 - DNA, 264 bp, Zea mays
gaaaatgccgtgggaaattttggagtctaaaatagggaattggattcatttcatgcgaattgctgttaaacttctttttgctggggagcgccaactttgcgaccaagtttttgagtgcagtcaatcgttgagggataagtgctttgctgcaataacaaagaacagtttggctacactactcagttttggagaggctattgctatgagtaaacgatcaccagagaaactctttgttctgttagacatgtacgagataatgtgcga

SEQ ID NO: 1715 - DNA, 264 bp, Zea mays
ctcagaaatatatagtgaagctcgttcttcagctttagaatcaagtctgaagaacttgggcgttgaaaaacttagcaaagatgaagtgcagaaaatgccgtgggaaattttggagtctaaaatagggaattggattcatttcatgcgaattgctgttaaacttctttttgctggggagcgccaactttgcgaccaagtttttgagtgcagtcaatcgttgagggataagtgctttgctgcaataacaaagaacagtttggctac

SEQ ID NO: 1716 - DNA, 318 bp, Zea mays
cgcctgtggctgttgatcctgaccgtcccacatcatcccttgctgtgcacattgcttggatcatggatgttcttcaaaagaatctggatatgaagtctaagatataccgtgatccatctcttgcttctatcttcctgatgaataatggcaagtacatcatacacaaggtgaatgacagtgagttgggtgttttactcggtgatgagtggataaagcagatgacaaatagagttcgacgctggagcatggattatcagcgggcaacatggggcaaggttacaactgtgctgcaaagtggcactccaggcattggtggac

SEQ ID NO: 1717 - DNA, 287 bp, Zea mays
cgcctgtggctgttgatcctgaccgtcccacatcatcccttgctgtgcacattgcttggatcatggatgttcttcaaaagaatctggatatgaagtctaagatataccgtgatccatctcttgcttctatcttcctgatgaataatggcaagtacatcatacacaaggtgaatgacagtgagttgggtgttttactcggtgatgagtggataaagcagatgacaaatagagttcgacgctggagcatggattatcagcgggcaacatggggcaaggttacaactgtg

SEQ ID NO: 1718 - DNA, 290 bp, Zea mays
cgacaagagcagagtgagatcgtcgtcagcgagcccagcagatacgagagagaggatggcggacatcgcgttgctggtggcggacagttcgagaagacggcaaggcgaggcgcccccggcggggacagcggtacgacagggtgaccggcggcgagacgaggaacttcggggccgtggccaaggtgtggagctcttgggtggagtccgcctccgccgccgcgtccggggtcagattcaccgtcgcggtgcagctggagcccaagaccgggctcgcgctggccgccgccgac

SEQ ID NO: 1719 - DNA, 312 bp, Zea mays
ggaccgtgggtcgtcagcgagcccagcagatacgagagagaggatggcggacatcgcgttgctggtggcggacagttcgagaagacggcaaggcgaggcgcccccggcggggacagcggtacgacagcgggaccggcggcgagacgaggaacttcggggccgtggccaaggtgtggagctcttgggtggagtccgcctccgccgccgcgtccggggtcagattcaccgtcgcggtgcagctggagcccaagaccgggctcgcgctggccgccgccgacggcctcttctccgcctagcgtcctgcttccatgt

SEQ ID NO: 1720 - DNA, 81 bp, Zea mays
agtttcacagacagcatccattccacagtcaccagagcactagagcagagcagcaacggacaagagcagagcgagatcgtc

SEQ ID NO: 1721 - DNA, 415 bp, Zea mays
  unsure (1)..(415): unsure at all n locations
cgcagttttcacagacagcttccacagtcaccagagcactagagcagagcaacaaccgacaagagcagagtgagatcgtcgtcagcgagcccagcagatacgagagagaggatggcggacatcgcgttgctggtggcggagcagttcgagaagacggcaaggcgaggcgcccccggcggggacagcggtagcgacagcgggaccggcggcgagacgaggaacttcggggccgtggccaaggtgtggagctcttgggtggagtccgcctccgccgccgcgtccggggtcagattcaccgtcgcggtgcagctggagcccaagaccgggctcgcgctggccgncgncgacggcctcttctccgcctagcgtcctgcttccatgtcttcctcctgagcagtgccagtggtcgagcgag

SEQ ID NO: 1722 - DNA, 72 bp, Zea mays
gacagcatccattccacagtcaccagagcactagagcagagcaacaactgacaagagcagagcgagatcgtc

SEQ ID NO: 1723 - DNA, 285 bp, Zea mays
cagacagcttccacagtcaccagagcactagagcagagcaacaaccgacaagagcagagggagagcgtcgtcagcgagcccagcagatacgagagagaggatggcggacatcgcgttgctggtggcggagcagttcgagaagacggcaaggcgaggcgcccccggcggggacagcggtagcgacagcgggaccggcggcgagacgaggaacttcggggccgtggccaaggtgtggagctcttgggtggagtccgccttcgccgccgcgtccggggtcagattcac

SEQ ID NO: 1724 - DNA, 273 bp, Zea mays
gctattccccatctccggaccagcgccgcctccagtcgctgtccacgggcaccccgggcgcgcctcctccgagcccagactcgagctccatcccgccgtggatcaccgcgtgaggtggggcgcaccgaccggaccccggagggccagatggtgtccggcgccggacggggcgagtagcgcggtcggcggccacgaacggattggcggcggcgcggcgaggcgtcggtcggagcgggggccaccatgtctgctgtagtgtgcggcaagaggtcc

SEQ ID NO: 1725 - DNA, 232 bp, Zea mays
agataataagcaatataatactgatctagaatcgagttgttgtactcttcgcagataggttcgttccttcacatagaagcgagtacagactacagaccacacagtatcagctggcacaaaacgaaaatggttacttgcaaattgcatgcacgagctagaattatattcttctaatcttcttcgttgactttctggcttcagcaggcgcgtgatggcgctttcagcttcccga

SEQ ID NO: 1726 - DNA, 116 bp, Zea mays
ctccgccgcaagctcaacgacaagctctacgcgctccgcagcgtcgtgccgaacatcaccaagatggacaaggcgtcgatcatcaaggacgccatcgagtacatccagcagctgca

SEQ ID NO: 1727 - DNA, 128 bp, Zea mays
acagaatgttgacattgccatcattgaagcaggtcttggtggagctagggatgcaacaaatgttattcgaagtactgaattagcagcatctgtcataacaacagtagggagggaacatctggttgcat

SEQ ID NO: 1728 - DNA, 223 bp, Zea mays
ggacggacgacaacgcctccatgatggaggccttcatggcttctgccgacctccccaccttcccctggggagcgccggccgggggcggcaactcgtcggccgccgcggcgtcgccgccgccgcagatgccagcggcgatggctcccgggttcaaccaggacacgctgcagcagaggctacaagccatgatagaggggtcgatggagacctggacctacgccat

SEQ ID NO: 1729 - DNA, 294 bp, Zea mays
atttaccagtgatgatgagagagatggaatggtcggggtaccaggggtctcaggaaatattttccaggagatagatgggaggcagttcgacagcccaatactggggagtagaaagcagaaaggtggatttggcaaaggcaaaggaaaagctaactttgcaactgaaagagagaggagggagcagtttaatgtgaagtatggggctttaaggtcactgttcccaaaccctactaagaatgacagggcctctatagttggagatgccattgaatacatcaatgagcttaatagaac

SEQ ID NO: 1730 - DNA, 304 bp, Zea mays
cccgttcccaaggagttgtcctcgccggcggatccggggcgccgctgcaagaggaggaaggaggaggagaggataccagaatggcgtcgcgctcggcgtccaaggatatcatcacgctgcgaggctctgccgccatcgtcagcgagttcttcgggtacgcggcgaatagcatcctctacaaccgcgctgtgtacccggaggagagcttcagcaaggtgaagaagtacgggctcaccatgctgctcacccaggacgagggcgtgaagaacttcatcgccagcctcacctcccagctctcagaatg

SEQ ID NO: 1731 - DNA, 270 bp, Zea mays
ggaatctgcaaaggccttatcaggcgtgatagaagctgtcagaccagaagggcctctagcgcttgttgtcggaatggctagtgacaaggagcatcttgcgtttgctgagcagcttctctcaggtcaaaccccagatgtcgtgctactgacagaggcgagtatcgccggaggaagctcccgtgcaatgccagcctcatccctgaaagaagtatggattgccgcggcacgccatcgtgacatcgagtacgtggacatcggtggcatcagtgg

SEQ ID NO: 1732 - DNA, 339 bp, Zea mays
agctctgccgccatcgtcagcgagttcttcgggtacgcggcgaatagcatcctctacaaccgcgctgtgtacccggaggagagcttcagcaaggtgaagaagtacgggcttaccatgctgctcacgcaggacgagggcgtgaagaacttcatcgccagcctcacctcccagctctcagaatggtggaggccgggaagctgcagcgtatcgtgctggtcataatgagcaaagccaccagcgaggtgctcgagcgctggaacttcaacatcgtcaccgacgccgaggtcgtcgagaagggggcatcaaggagaagagcgcaaggagatcgatgaggagatc

SEQ ID NO: 1733 - DNA, 241 bp, Zea mays
cgacgacgacgaggaacatggacatggagaggacccgccgcaggaagctcaacgagaggctctacgcgctccggagcgtcgtgcccaacatcaccaagatggacaaggcgtccatagtcagggacgccatcgcccacatcgagcatctgcaggagcaggagcgccgactgctcgccgagatatccgttctccagtcttctgacgacggcaccgccgccgccgccgccgtcaagacggagga

SEQ ID NO: 1734 - DNA, 366 bp, Zea mays
  unsure (1)..(366): unsure at all n locations
gccagcgcttcatcgcgctctccaagatcgtcncgggcctcaagaagatggacaaggcatccgtgctcggcgacgcgatcaagtacgtgaagcagctgcaggaccaggtgaaggggctggaggatgacgcccggtagcgcccggtggaggcggcggtgctggtcaagaagtcgcagctgtccgccgacgacgacgagggctcctcctgcgacgacaactccgtgggcgccgaggcctccgccacgcttctgccggagatcgagagcccggctgtcgggccgcacggtgctggtgagggtccactgcgacaaccgcaaggtggtgctcatcgccgccctctccgaggtggagcgcctcggctctccg

SEQ ID NO: 1735 - DNA, 310 bp, Zea mays
gccagcgcttcatcgcgctctccaagatcgtcccgggcctcaagaagatggacaaggcatccgtgctcggcgacgcgatcaagtacgtgaagcagctgcaggaccaggtgaaggggctggaggatgacgcccggaggcgcccggtggaggcggcggtgctggtcaagaagtcgcagctgtccgccgacgacgacgagggctcctcctgcgacgacaactccgtgggcgccgaggcctccgccacgcttctgccggagatcgaggcccggctgtcgggccgcacggtgctggtgagggtcactgcgacaac

SEQ ID NO: 1736 - DNA, 261 bp, Zea mays
gagctttcagaggcttcccagatccttaattgtctgtctgatttggtctactggacggtttgtgcatgtatgcagacgcagcacaaagtcgaaatggacaagagggatggaaagttcagcccacagcctatggcagtgcccccggtgcaacaaatgtcacgcatcgatcagcctatgccgcctcctgctggatatgcaccgcaaccagcatatgggcagccttatggtggctatccatctcctcctggccaaggttatccg

SEQ ID NO: 1737 - DNA, 256 bp, Zea mays
cagatccttaattgtctgtctgatttggtctactggacggtttgtgcatgtatgcagacgcagcacaaagtcgaaatggacaagagggatggaaagttcagcccacagcctatggcagtgcccccggtgcaacaaatgacacgcatcgatcagcctatgccgcctcctgctggatatgcaccgcaaccagcatatgggcagccttatggtggctatccatctcctcctggccaaggttatccacctcctcctggcc

SEQ ID NO: 1738 - DNA, 390 bp, Zea mays
acccgtccatgctatggctcgccgacgcgccggtcatggacatcaagggtggcttgtcgcacccgtcggccgagatctccgtctccaagcctccgccgcatccgccgcagatccattttgagaacgggagcacgagcacgctcacggagaaccccagcccctccgtgcacgcgccgccaccctcgccggcgccggctgctccacagcagcggcagcaccagcaccagaatcaggcgcaccagggcccgttccgccgggagctcaatttctcggacttcgcgtccactccttccttggcggcgaccccgtcgttcttcaagcccgagttcggcgagatcctcagcttcggcgccgacagcaacgcccggaggaacccgtcgccggtacctt

SEQ ID NO: 1739 - DNA, 379 bp, Zea mays
agggcctccccgggcaggcgctcttcgccgggcagcccacatggatcgcctctggcctctcctccgcgccgtgcgagcgcgcgcgtcaggcctacaacttcggcctccgcaccatggtatgcttccccgtcggcaccggggtgctcgagctcggctccaccgacgtcgtgttcaagaccgccgagagcatggctaagatccgctcgctctttgggggcggagcagggggtggctcgtggccgcccgtgcagcctcaggcgccgtcgtcgcagcagcccgccgccggagccgaccacgcggagacggacccgtccatgctatggctcgccgacgcgccggtcatggacatcaaggattccttgtcgcacccgtcggccga

SEQ ID NO: 1740 - DNA, 253 bp, Zea mays
gatgcgtgatcgccctgcttatgaacaaaaggtgaaagagtactgtgaaaaatacgccaaaccagaggatgctggtgtcagcccagaagacgagtccagtgacgaagagctgagtgaagaggaaaatgactcgggtgatgaggagataatgggcagcccagacacatagtcgagttggaacctagatctgtaatctgcacacgatgtttattgcagcaagtgcaattaaatagtccatggatgttccgtgcag

SEQ ID NO: 1741 - DNA, 257 bp, Zea mays
  unsure (1)..(257): unsure at all n locations
atcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcgcatctcaactgtggtgcanaaactttgg

SEQ ID NO: 1742 - DNA, 335 bp, Zea mays
gcacgttcgcacgaatcactgctctgctttcaccccccgcatcgaacctcacccccgatctgatcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactga

SEQ ID NO: 1743 - DNA, 266 bp, Zea mays
gcccgttcgcacgaatcactgctctgctttcaccccccgcatcgaacctcacccccgatctgatcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgc

SEQ ID NO: 1744 - DNA, 271 bp, Zea mays
catcgaacctcacccccgatctgatcgaatcgaaggctgcggcggcgatgggcggtgaccatggcggtgggcacgccggcggcgacttccgccagaaggtatggagcatgacgggcggcccctactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaa

SEQ ID NO: 1745 - DNA, 404 bp, Zea mays
cgaacatcacccccgatctgatcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctccaactagcatgaagtgcgggcaccttgcttttgccttctttttgtggaaacctgtgcctagccataatgctgggttaagtgttaggagcatctctggaatgc

SEQ ID NO: 1746 - DNA, 267 bp, Glycine max
  unsure (1)..(267): unsure at all n locations
aaggaactgagcagggagttagggttagagccattgcaggttaagtnttggtttcagnncaagcgtattcagatgaagacacagcacgagcggcatgagaatacaaatctcagaaccgaaaacgagaagcttcgagcagataatatgaggtatagggaggctcttagcaatgctcgtgtcctaattgtggtggaccaaccgctataggaganatgtcattcgatgaacatcacttgaggcttgnaaacgcaaggctaagagaagagg

SEQ ID NO: 1747 - DNA, 287 bp, Glycine max
aattaagatggctcagcctgatacctctctttggattaaaagctctgatggcaggaatgaagtactgaaccatgatgagtatgcaagactgttttctccttatattggatcaaaacctgctgctggttatgtgactgaagctacaagaggaactggagtagtatcagccagcagtttgggccttgttgaaatattgatggatgcggatcaatggtcggagatgttttcatctatgattgctagtgctgccactgtggaagtactatctagtggcacgggtggaacca

SEQ ID NO: 1748 - DNA, 281 bp, Glycine max
  unsure (1)..(281): unsure at all n locations
gattgancatcnnanaacganggtcacactnctatctatgnttgacgacgtggacnggagatacnaccantactgtganaanatncncatggtagngaactcatttgacntnatgatgngatttggggcggcagtgccatacacagacactggcgcagaaagcaatgttctcggnatttaccggtgtctggaaggaggcgataacagcgcactgatagcaaagttgtgnagtactggngacaaagatggggctgnaagttcaggaggtttgancaanggtt

SEQ ID NO: 1749 - DNA, 334 bp, Glycine max
  unsure (1)..(334): unsure at all n locations
tgattatgaggaggatctaaaacagatgaagaatctttcaaagcaggagttcgtgcacatacttcgccgccacagtaccggtttctcaaggggcagttcgaaataccggggagtgacacttcacaaatgtggccgttgggaagctcgaatgggacaattccttggcaagaagtatatatatcttgggctattcgacagcgaagtagaagctgcaagnngcttatgacaaggcagctatcaagtgcaatagaagagaggctgtcactaactttgagccaagtatatatgagagcgagatgaaacctgaagctattaatgaaggtggcagtcacga

SEQ ID NO: 1750 - DNA, 353 bp, Glycine max
  unsure (1)..(353): unsure at all n locations
ccgaaaggttgggagcaccaccagaactggcttcacttcttgaagaaatagcccgtgaaagctacccaacggatgctcttcgtgagataggagatgatcctgaacttgacgaattcatggagtcatactgcgaagttcttcatagatacaagcaggagttgtcgaagccattcaacgaagcgaccttgtttttgtgcagtatcgaatcacaactcagcaatctttgcaagggaacactgacaatgccattggataacaaccactcagatgaggccgctggaacatcagaggatgattgagttnggagaagtgggagcagttgaaggcacgancttctgggccngtcccagtga

SEQ ID NO: 1751 - DNA, 141 bp, Glycine max
  unsure (1)..(141): unsure at all n locations
cgtgagtggaaaacgtagcgagagagaagaaccgaacggcgaagaacacgacatggacagagcctgttcccgcggaatcancgacgaggaagacgctgaaaccgcaaggnaaaaacttagactctccaaagaccntnccgc

SEQ ID NO: 1752 - DNA, 256 bp, Glycine max
  unsure (1)..(256): unsure at all n locations
ggatttattaatttcaaaaaatgcaacaacatctagaaaatggaaccgaagtgtcaacactcccactccctattatggtaacatgcaagcaagaagatgccaattcagccaaaagtgatgtgcttgattcggatagcccacattgcactgattatgggaaccacccttcctcattcgnggagcctgctgattcctctcatgcctttgaaccngnngaccactcagaagacttctcacaagatgaagaggataacct

SEQ ID NO: 1753 - DNA, 242 bp, Glycine max
gccagaacatccaccacggaagtgatatctagtggaattaacggaacaagagatggagcacttcaattaatgcatgctgaacttcaagttctttcgcctttggttccggttcgtgaggtgaatttcctacggttttgcaagcagcacgcagaagggttgtgggctgtggtggatgtgtccatagatagcatcagagaaagttcaggagcacccacttttgtgaacggtaggaggcttccttc

SEQ ID NO: 1754 - DNA, 244 bp, Glycine max
gtgtaactgtaattctgagactaatgacatccccagcggcgagggcatatacactctaggattataatctatgaagcatcaacactctaatttcttgttatgtttggtgtccaacatgtgtttggcaataacagcagggggaaggcggagcatgatgaagctggcgcacggatgacgaacaacttctgcgcgggggtgtgcgcgtcgacggtgcacaagtggaacaagctcaacgccggcaacg

SEQ ID NO: 1755 - DNA, 267 bp, Glycine max
  unsure (1)..(267): unsure at all n locations
atgaagactggggtcctggcaaaagaaagcgangagnaaaggagtctgatgctgttgattctcttatgactttgcatnaaagtgagaataggcatcccaataatgagnanaacatganangtanagattctncaagcataaagntcaaaaggcnttgttttaggattncacgtgatgcagttgagangcttcncnaagtttttgctgagaacnnncntcctccaagatctataaganagggtntttcaaaagngctgggccttgaca

SEQ ID NO: 1756 - DNA, 260 bp, Glycine max
  unsure (1)..(260): unsure at all n locations
gcctgagaaggagcttcagcgggctaagtcggaaattcttcgacgcaaattgaaaatnnagggatctatttcaaaatttggattcattgtgtgccgaaggaaagtttccagaatctttgtttgattctgcaggagagattgacagtgaggatatattttgtgcaaaatgccagtccaaagagttgagcactaataatgatataattctttgtgatggtgtttgtgaccgtggatttcaccagctctgtttggatcctccg

SEQ ID NO: 1757 - DNA, 154 bp, Glycine max
ctcgagccgcgcgcgcaaaggattagggtttcgaacgtagcgcttttggagcttccattacgatttcatacttgcgcacgatcaggagggagggctttggagttgaatgcattgctcgtttttactgaaaggagaacccgcgctctctttggtt

SEQ ID NO: 1758 - DNA, 262 bp, Glycine max
ggggaaggcacgggagcaacaatgtctgatgacgaagatgagcaagtaggtagtgatgccaatctgtttgatggtgctttggatggtcctgatagcatgggattcggtcctcttattcccacagagaatgagaggtccctcacggaacgtgtaagacctgaagtaaagcacgaattgaaacagggttataaagagaaaattgtggacataagagaggaaattttacgcaagagatgagttgggaaacttcctggtgacacga

SEQ ID NO: 1759 - DNA, 262 bp, Glycine max
gtgaagaactccaagttcttggtgcctgcacaagaccttctcatagagttttgtagccttgacgcaaagcaaagcgacttgggaaagccaacaaaatcgttgaataagaagcagtgggaagaggaaaataacggtatcggttcctcgaagaagcattctctgacctctctagagttcgtggagttgcagaagagaaagacaaagctgctttcgatgctggaagaggttgacagaaggtacaagcactaccgcaatcagatga

SEQ ID NO: 1760 - DNA, 271 bp, Glycine max
gttctctgtgatgccaaagtttcactcatcatggtctctaaaaaccacaagatgcatgaatacattagcgctggcctcacgacaaaaaagatcattgatcagtatcagaagcctttgggggatattgatctgtggcattctcactatgagaaaatgcttgaaaacttgaagaagctgaaagatattaacaataagctcaggagacagatcaggcataggataggtgagggcttggacatggacgacatgagcttccagcaactgcgcactc

SEQ ID NO: 1761 - DNA, 266 bp, Glycine max
gcacaatatttgattgtgttatgtacgttcaaagagcagcttcagcaacatgtgagggtgcatgccgtggaggctgtgatggcctgccgtgatattgaaagtaccttgcaagctctgacaggagtcagtttgggagaaggaacaggtgcaacaatgtcagatgatgaagatgatttgcagatggatggctctttagatcagtctagcgctgacgggcatgacatgatgggatttggtccattgcttcctacagaatctgagaggtc

SEQ ID NO: 1762 - DNA, 240 bp, Glycine max
tgcaatgattggtgaaatttcactcgaagatcagcatcttagaattgagaatcctagattgaaggacgaactagaccgtgtttgtgcactcgctggcaagtttttaggtcgacccatttcatctctaacaggctcaattgggcctccattcccaaactcaagcttggagcttggtgttgggagcaatggttttggaggattaagcactgtgccttcaacaatgcctgattttggggttgg

SEQ ID NO: 1763 - DNA, 267 bp, Glycine max
tcttaactatgcttgatgaggtttacaggaggtacaggcaatactatcagcagatgcaagcggtagtaacttcatttgagtatgtttctggcctgagcaatgcagctccctatgcaagtttggctataaaagctatgtccaaacattttagatgcttgaagaatgcaattactgatcagattcagtttgccaataaagctcattttcatatcagcaacaggaaagatgaatctccaaggtttggcaacagtgatagaggcccatatg

SEQ ID NO: 1764 - DNA, 258 bp, Glycine max
gtcattttcagggattgagcttggagaagaagctaatgctgaggaagatttgtctgatgatggatcacaggctggagagaagaaaaggaggcttaacatggaacaagtgaagacccttgagaagagctttgagttgggaaacaagcttgaacctgagaggaaaatgcagttggcaagggctcttggcttgcaacctagacaaattgctatatggttccagaacaggagggctaggtggaagaccaagcagttggagaa

SEQ ID NO: 1765 - DNA, 231 bp, Glycine max
ctgccatcagatgcagattgtggtgtcatcttttgacatggttgctggctgtggagcagcagaaccatataccacacttgccttaagaacaatttctcgccactttcggtgtttgcgtgatgccatcagtggccaaattcaggtgacccaaagaagccttggggagcaagaaggaataccccgtctccgctatgtggatcagcaacttagacaacaaaaggcacttcagca

SEQ ID NO: 1766 - DNA, 236 bp, Glycine max
gctgaagatgctggaacaaagcttgaggcagcaaagagcgtttcatcaaatggggatgatggaacaggaggcttggaggccccagagagggttgccagaacgatctgtcaacattttgagagcctggcttttcgagcatttccttcatccgtacccaagcgatgcagataagcatctgttggcacgacagactgggctatcgagaaatcaggtatcaaactggttcattatgcgag

SEQ ID NO: 1767 - DNA, 237 bp, Glycine max
aattgggtttacagaaacagaagcaagctttggcgaagcagttgaatcttaggccacgacaagttgaggtgtggttccagaacaggagagccagaacaaagctgaagcagacagaggtggactgcgagttcctaaagaaatgttgtgagacattaacagacgaaaacagacggttacagaaggagcttcaagagcttaaagcactgaaactggctcagcctctgtacatgcctatgc

SEQ ID NO: 1768 - DNA, 245 bp, Glycine max
agaaccaaaaacttcaggctgagatattggcactgaaaagtagagagccaacagaatccataaaccttaacaaagaaacagaaggatcctgcagcaatagaagtgagaacagctcagacatcaagttggatatctcaaggacaccagctattgacagtcctcattctacacatcagcaacagccaagcagacccttctttcctccttcttctgttaggcctgcaggagttgctcagcttttccaa

SEQ ID NO: 1769 - DNA, 222 bp, Glycine max
gtagaagtcgatgatagaggtgttcacaatctttacaagcagcttgtttgctctggacctgcatttggtgcaaaacgttgggttgcaaccttagatcgacaatgtgaaagactcgctagtgccatggctacaaacattcccactgtagatgttggcgtgataacaaaccaagacgggagacagagcatgatgaagctggctgaaagaatggtgataagcttt

SEQ ID NO: 1770 - DNA, 194 bp, Glycine max
gtagaagtggatgatagaggtgttcacaatctttacaagcagcttgttttctctggacatgcatttggtgcaaaacgtttggttgcaaccgtagatcgacaatgtgaaagactcgttattgccatggcatcaaacattcccactgtaggatgttggcgtgataacatgccaggacgggatagagatcatgttga

SEQ ID NO: 1771 - DNA, 246 bp, Glycine max
gaaagcccacaatacactgatggagttcactctgcacttctagagactggtgattcttcttatgtgttcgaacctgatcgatctgatgtgtctcaggatgaagaagataacttgagcaagacccttctgcctcattacatttttcccaagcttgaagatgttgattactccgacccacctcatggttcatgtaattttggaattccggaggaagatcaagccatttggtcttggccttactgaatt

SEQ ID NO: 1772 - DNA, 260 bp, Glycine max
ggggaagcttccaggggacaccacatccctagtgttagcttggtggcaatcacattctaaatggccttaccccactgaggaagacaaggctagattagtgcaggaaacagggttgctcttaaagcagataaataattggttcataaatcaaaggaaaaggaactggcatacaaataacccctcatcctctagcaactccaaaagcaagcgcaagagtagtgcaggagaagccagtaaccagagcttcatgtgaacggtcg

SEQ ID NO: 1773 - DNA, 256 bp, Glycine max
ggcagcaagaatcttggtagtgctcttgtgcaaacatgagtttgatgtgagataccagatgcctgaagataaattgtatattgctcagctatatttcccacttgttggacaggaattaagtgaagaagctgacatgtgccttcttgcacaatttgatggatagtcttaaaacggtggaggaatggacaatctgtagagtcgtgggaggctcataaggcaccggtccaaactatcataaagctgccctcaagagagt

SEQ ID NO: 1774 - DNA, 236 bp, Glycine max
ccaagcttgaacccgaaaggaaggtccaacttgcaaaagagcttggcttgcagccaaggcaagttgctatatggttccaaaaccgaagagcaaggttcaagaccaagcagctagaaaaagactatggcgtgttgaaagctagttatgataggctcaaaggtgactatgaaagtcttgttcaagagaatgacaagttaaaagcagaggtgaattctctggagagcaaattgattctt

SEQ ID NO: 1775 - DNA, 226 bp, Glycine max
gcaaattgtggtatcatcatttgagcaagcagcgggttatggggcggcaaaatcttacactgcccttgccctaaaaactatctcaaagcaattcaggtgcctgaaagatgcaatctctgcacaaatcaaagccacgagcaagacattgggtgaagatgattgcttaggagttaaagtagaacagtcaaggcttaggtatgttgaccaccatcttcggcaacaaagg

SEQ ID NO: 1776 - DNA, 220 bp, Glycine max
gcaaatacagcggccattttagcggtttgagaaaggaatttctaaaacgaagaaaaaagggtaagctaccaaaggatgcaaggatagcactcatggactggtggaacacccatcatagatggccttatcctacggaagaggagaaagtgaagttgtcagaaattactggactggatcaaaagcagatcaataattggttcatcaatcagagaaaacgtca

SEQ ID NO: 1777 - DNA, 241 bp, Glycine max
ataattcacccactaaatcacttgagggctgttcgaaatctggttccagggataaaaagtctggatcttcagcacacaaaagactaggagaagccgtagttcagagacttcacaaatcttttaaagaaaatcagtatccagatagaaccacaaaagaaagcttggcacaagaacttggacttacttatcagcaggttgccaaatggtttggcaatacacgttggagcttccggcattcatc

SEQ ID NO: 1778 - DNA, 203 bp, Glycine max
gtgttgtgtgagatataagagcgtagaagatggtgagactgagataattgatgatcaatgagtggaagctgatcgatgggagtcgccacacggaggcatgccacgtgtgctgccagaagctgctcgtacagcggatgagtcgctatctccgccttcagcttccacacaacatacgagagtcttctggcatcatacgtggcatg

SEQ ID NO: 1779 - DNA, 263 bp, Glycine max
gtggttgcttcatctatgtgatgcacatcaggaaatgcagtcataggcagaagctgctcagtgtgctgttgctgttgctggtgttgtaatgcaggcccttggtgccagaaacgatggtgtttgagcaaagaccacgtttctgctttacggaatattggtcctatggttagcaatgacattacgtctgaagcatctgctgcggaggttgagggatatggtgcttcaaaactgactgttgactcggctgtgaaatacttgcagct

SEQ ID NO: 1780 - DNA, 261 bp, Glycine max
gtctaggtggatttgacacagcacatgcgatatgctcgtgcttatgatagagcggctattaaattccgaggagaggaggctgacattaacttcaatattgaagactatgaagatgacttgaagcagatgagcacttaccaagtaagagttcgtccacgtgcttcgccgacaaagcactggatttccgagaggaagctccaaatatagaggtgtcactttgcacaagtgtggaagatgggaggctcgaatgggccaattttt

SEQ ID NO: 1781 - DNA, 278 bp, Glycine max
ctcttggcagcctacgtcaattgtcaaaaggttggggctccgcctgaagtggtgggaaggttagaagaagcatgtgcatctgctgcagtgataatggcaggtggaacagccagcataggcgaggatccagcgctggatcagttcatggaggcttactgtgagatgctgatcaagtacgagcaagagctctccaaacccttcaaggaagccatgctctttcttcagaggatcgagtgccagttcaaatctctcactatttcttcttctttggacactac

SEQ ID NO: 1782 - DNA, 275 bp, Glycine max
tggacctactgaagctgataagccaatcataatagagcttgctgttgcagccatggaggagctcattggaatggcgcaaatgggtgagcctctttggttgactaccctggatggcaccactggctcaacgatgatgagtacatcaggtcttttcctcgagggattggtcctagacccgttggtctcaagtgtgaagcttctagggagactgctggtttgatcatgaaccatggtaaccttgttgagatcctcatggacgtgaatcaatggtccac

SEQ ID NO: 1783 - DNA, 230 bp, Glycine max
tcgagccgaatcggctcgagtggagaaaacagtggtgggctatcccaatgacgatgaaccctttggtaacttcccatcatgcaacaaatcctagtaatcctagtaataatactaataataatgaaaacacaaactgtctcttcattcccaactgcagtaacagttctggaactccttctatcatgctccacaacaacaacactgatgatgataacaacaaaaccagcact

SEQ ID NO: 1784 - DNA, 227 bp, Glycine max
ccgtctcttggcagcttacgtcaattgtcagaaggttggggccccgcctgaagtggtggcaaggttagaagaagcatgtgcttctgcagcgacaatggctggtggtgatgcagcagctggatcaactgcataggtgaagttccacctttggaccagtcattgaggcttactgtgagatgctcacaaagtatgagcaagaactctccaaacccctaaaggaagccatg

SEQ ID NO: 1785 - DNA, 254 bp, Glycine max
ctaaggatggggaacagtgggtttttgtattacaatcaagcaagtggaggaccctcttcttataagagtactcttgggggtcatcaccaccaagcattgttggcacagacccaccagggacatgttgggtttggggcagcatcatcgtctacatcatccttaggtgttgtgaatgcgttgaggaattcaaaatatgccaaagctgctcaggaattgcttgaagagttttgcagtgttgggagaggccagttcaa

SEQ ID NO: 1786 - DNA, 244 bp, Glycine max
tgaggctcgaaaatgctcgcctgagagaagagattgataggatatctgccattgctgcaaagtatgttgggaagcctgtggtgagctatccacttgtttctccttcatctgttcctcctcgtccactagaacttggggttagtggtggttttggtggccaacctggaggcattggaggggacatgtatggtggagctgcaggagatcttctaaggtcaataagtggacctactgaagctgataa

SEQ ID NO: 1787 - DNA, 259 bp, Glycine max
gttccaaaacagaagggcaaggtggaaatcaagcgcatagagcaagagtacagaaaactcaaagatgaatatgacaatttagcatcaaggtttgagtccctaaagaaagagaaggactctttgcaattagagttgcagaagctaagtgatttggtggtgacatctcaagatggtggaagggaagacaaggatggcaaagaaaacagcatagaagatggtggctcaggcagtggatacagcagttggaagcctgaagcaa

SEQ ID NO: 1788 - DNA, 251 bp, Glycine max
gtaagtatggtggttatcttagcagcttgagaaaggaatttctaaagaaaaggaaaaaaggtaagctaccaaaggatgcaaggatgatactcatggactggtggaacaacactataggtggccttatcctacggtaattgaaattaatatcatgaagtatatatatagcaatatagcttacgttatattgtgtattgctcattaacagtagtatgtgatctgatttgatgaaatatgccaaattgcccata

SEQ ID NO: 1789 - DNA, 256 bp, Glycine max
gcttgatcagttcatgacccattatgttctgttgctctgtgcctttaaagaacaactgcagcagcctgtccgtgttcatgccatggaggcagtgatggcttgttgggatctggagcagtctctgcaaagcttgacaggtgatctcctggtgaaggaacgggtgcaacaatgtcagacgatgaagatgaccaggcagagagcaatgccaacttatacgaaggaagccttgatgggggtgaaatcttggatttggtcc

SEQ ID NO: 1790 - DNA, 227 bp, Glycine max
atagaggtgtaactttgcacaagtgtggaagatgggaggctcgaatgggccaatttttgggcaaaaagtatgtttatctgggtctgtttgacaccgaaattgaagctgcaagggcatatgataaagcagcaataaaatgtaatggcaaggaggctgtcaccaattttgatcctagcatctatgatagtgagcttaattctgaatcctcaggaggtgtagctgcagat

SEQ ID NO: 1791 - DNA, 250 bp, Glycine max
gtgaagttgtaaatgaagatgaatacctgagggttttccctaggggcataggtccaacactcttgggcgcaagaaccgaatcttctaggcaaacagccatagttatcatgcatcatatgaaactcgttgagatgcttatggatgtcaatcaatggtcaaacatgttttgcggcatcgtttcaagggcggtaacacacgaagtgctgtcaactggagaaactataagatacgatggtgcctgccaagtgat

SEQ ID NO: 1792 - DNA, 270 bp, Glycine max
gccatggaggaaatgatcaggctactgcaaacgaatgagcccttgtggatgaaaggtgctgatgggagggatgtccttgatcttgattcctatgagagaatgttccccaaggctaatagtcacttgaagaaccccaatgttcatgctgaagcttctagagattcaggagttgtaattatgaacggcttaactttggttgagatgtttatggacccgaacaagtggatggagctatttcccaccattgtcacaatggctagaacaattgag

SEQ ID NO: 1793 - DNA, 269 bp, Glycine max
aattggttcataaatgcacgagtacggctatggaaaccaatgatagaagaaatgtacaaagaggagtttggagagttttctgaagactccaacccggctggtaacaactacttgacgagggaagataccacggattgtgtagaggattgaatcaaaagctccagtgaacaaaaaacttattgtttgacaaacatgggcctttaaatgcttgcctttttcctccaaaatcgagagataaacattatgtaacatgacaagatgatgagcca

SEQ ID NO: 1794 - DNA, 261 bp, Glycine max
ggggcgccgacgtggttgaacaacagcaacgccgccacgctccgccagcagaatttcctccacctccagccggaatccgccgcgacggcgcgcagcaaaacgacgacgttcgtgctatggatcggaaccggaccgagagcaactctgaagcggacgatttggcggaatacaaagcagatattttaggtcaccctctctacgaccagctcctatcggcgcacgtctcgtgcttgagaatcgccacgcccgttgaccagcttc

SEQ ID NO: 1795 - DNA, 253 bp, Glycine max
ggattatcttataggataataccaaattagaatgaaaattatcctgtgagaagtgaaattgtgattgtgaattgaatgaaggatgctcgaatttgagttattgatatggcttttgagtcgcactatgttttgttgctctgttccttcaaagaacaattgcagcagcatgtccgggtccatgcaatggaagcagtaatggcttgttgggatatagagcaatcattgcagagtctaacaggagtttcacctggag

SEQ ID NO: 1796 - DNA, 252 bp, Glycine max
ggaacgggtgcaacaatgtccgacgatgaagaagatcaggcagagagtaatgccaacttgtacgaaggaagcatggatggagctgatagtctcagctttggtcctcttgttcccacagaaactgaaagatctttgatggagcgtgtgaggcaggagctgaagcatgagttaaaacagggttacaaggacaagattgtggacataagagaagaaattttacgaaagagaagagcgggaaagctaccaggcgac

SEQ ID NO: 1797 - DNA, 245 bp, Glycine max
gcagaacaaagctgaagcagacagaggtggactgcgagttcctaaagaaatgttgtgaaacattaacagatgaaaacagacggttacagaaggagcttcaagagctgaaggcactgaaactggctcagccgttgtacatgcctatgcctgcggcaacactcgccatgtgcccctcttgcgagaggctcggcggcagcgccgtcaacggtgccggcggttcccccaagacatcattctccatggcc

SEQ ID NO: 1798 - DNA, 253 bp, Glycine max
gcaaaagcaagctttggcaaagcagttgaatttgatgcctaggcaggtggaggtgtggtttcaaaacagaagagcaaggaccaaattgaagcagactgaagtggattgtgaatatttgaagaggtgctgtgagaatctaactgaagagaataggaggcttcaaaaggaagtgcaagagctcagggcattgaagttatccccacagctttacatgcaaatgaaccctcccaccactctcacaatgtgcccttca

SEQ ID NO: 1799 - DNA, 287 bp, Glycine max
  unsure (1)..(287): unsure at all n locations
gnaagaagaaaagacaaaggaataacatagatgttgatgatgcttcacgcttgcgaaggagaacaaggtacctcttaatcaaaatgaagctagagcagaaccttattgatgcttactctggagaaggttggaaaggtcaaagtcgggaaaagattaggccaganaaggagctactacgagcaaaaaagcagattttaaaatgtaaacttagtattcgcgatgccatacaccagctgggattctcttagttctgtgggtagcatgaagattctgccattgctccagag

SEQ ID NO: 1800 - DNA, 279 bp, Glycine max
  unsure (1)..(279): unsure at all n locations
cggatcttcagcacacaaaagactaggagaagccgtagttcagagacttcacaaatcttttaaagaaaatcagtatccagatagaagcacaaaaganagcctggcacaagaacttggacttacttatcagcaggttgccaaatggttcgacaatacacgttggagcttccggcattcatcacaaatggaaaccaattctggtagaaatgcttcaccggaagctaccgatggcagggctgaaaatgagggggagaagcaatgtgaatcaatgtctccgga

SEQ ID NO: 1801 - DNA, 266 bp, Glycine max
  unsure (1)..(266): unsure at all n locations
cggcgccggggagtccatggtggagcacgccgatttgaaggacggcggcggagacgcctgagctggnanattgggcggtgtaagacggagattctgcagcacccgctgtacgagcagctgctgtcggcgcacgtngcgtgcctccggatcgccacgccggtggaccagctgccgangatcgaacgcgcactggcgcagtcgcagaatgtggtcgcgaaatacgcagtnttcgganacaacaacatcgtcgccgatgtacaaannnc

SEQ ID NO: 1802 - DNA, 275 bp, Glycine max
  unsure (1)..(275): unsure at all n locations
ctccgcgtggccacacccatcgatcagttgccactcatngacggtcagttatcgcagtcccaccatctcctccgctcttatgcctcacaccattcccattccctctcgccccatgaccgacaagaacttgacaacttcatggcacagtatttgattgtgttgtgtacatttaaagagcagcttcagcaacatgtgagggtgcatgccgtggaggctgtgatggcctgccgtgatattgaaagtaccttgcaagctctgacaggatcagtttggga

SEQ ID NO: 1803 - DNA, 270 bp, Glycine max
  unsure (1)..(270): unsure at all n locations
gaaagacaaagctgctttcgatgctggaagnngttgacaganggtacaagcactaccggaatcagatgaagagtgtggtgtcatcgtttgangcggtggcggggaatggtgctgcgacagtgtactcagctctggcgttgaaggccatgtcgagacatttcaggtgtttganagatgggattttgtcgcagattcaggcaacaagaaaagcccatgggagngaaaccccattgcaccaggcacaacaaaggggcganaacgcaagcctta

SEQ ID NO: 1804 - DNA, 268 bp, Glycine max
  unsure (1)..(268): unsure at all n locations
gacgnacacagtccgaggaacaacnatgtgtatggganggagttccagtccntgctggcaggnctcgangaagaagggtgcgtggaagangcagggcaccantctgagaagaaacgacgactaaacgtagntcnngtgaaggccttggagaanaacttcnaagtagagaacaaactggannnngaccgnaacgtgaagntcgngcaagaaatcggcttgnaaccaagacaagttgcggtttggntnaaaaccgccgtggcagatngac

SEQ ID NO: 1805 - DNA, 285 bp, Glycine max
  unsure (1)..(285): unsure at all n locations
tgcttttcttctcaagaattgagtgccagctcaaagccctagcagtttcatcagattttggtcaaagtgaaacatcttcaaagaatncaggttgancttcatgaaaacaacctagattctcaagctgaagaccgggaactcaaagtccagcttttgcgcaagtatagtggatatctagggagcctcaagaaggaatttttgaagaagaaaaagaatggaaagttgccaaaggaagctcggcaacagctacttgattggtggaacaggcatataatggccataccc

SEQ ID NO: 1806 - DNA, 155 bp, Glycine max
  unsure (1)..(155): unsure at all n locations
gttaatgttctaaganattcaaagtatgcgaaggctgcacaagagttgctggaagagttttgcagtgtagggaggggtcagtttaagaagagcaagttcaataggcagaattcaaaccctaattcaaatgccggtggtggtgcttcgccttcatc

SEQ ID NO: 1807 - DNA, 291 bp, Glycine max
aattatcaagcacaaattaataatatccgtacgtgtggaacgataaagctttagttctacaaatattaaacaatttaattaattaattaacacctacaatcatttgctggttgttgtctaattagaaaggcttattaatattgaatttgtgtggttcacaagtttgataaattcataagataataacatgactttgtggtatattaagattttggggtgtgtgttgcagaacaaagctgaagcaaacggaggtggactgtgagttcttaaagaaatgctgtgaaacattga

SEQ ID NO: 1808 - DNA, 234 bp, Glycine max
gaaagatgcgcctgcctatgaactattacgtgaagatgaagactggggtcctggcaaaagaaagcgtcgagaaaaggagtctgatgctgttgattctcttatgactttgcatgaaagtgagaataggcatcccaataatgagcacaacatgacaagtaaagattcttcaagcataaagatcaaaaggcattgttttaggattccacgtgatgcagttgagaggcttcgccaagt

SEQ ID NO: 1809 - DNA, 257 bp, Glycine max
cttgttcacccttccccttctccttacttctcactctctttccaatacactccctttctctttccccttacccttcttctgtgtgtgatgatgtagatagagaataaaaagagaccagtgtgcagtgagaaagagacgaacacagtccgaggaacaaccacgtgtatgggaaggagttccagtccatgctggaaggactcgacgaagaagggtgcgtggaagatgcagggcaccactctgagaagaaacgacgacta

SEQ ID NO: 1810 - DNA, 125 bp, Glycine max
cgagaatctgacggaggaaaatagaaggttgcagaaggaggttcaggagcttagagcactgaaactttccccacagttttacatgcaaatgcaccccacccacgaacgctacaccatgtagcccc

SEQ ID NO: 1811 - DNA, 274 bp, Glycine max
gttgataaacatatcctagcccgccaaaccggtctctccagaagtcaggtttcgaattggttcattaacgcgagggtgaggctatggaagccaatggtggaggaaatgtatttggaagaagagaaggagcatcaaaacgacgtagcatcgtcggagggaggaggcatcaatattctcggggatcagaagccaacacaggctcgactcgttcgaattgactcagagtgcatgtcgtctatcgtcaacaacccagatgacaaaaacgacacaaaga

SEQ ID NO: 1812 - DNA, 252 bp, Glycine max
tcggcatacggctcgaagtgctctgcacttgaacactaggggtcgtcaatggagatggtgcatgatacagaacatgacccattctgttctgttgctctgtgcctatatgagaacaaatacagcagcaagaccgtgaacttgcaatggaggcagtagtggcttgatagggatctggagcagtctctgcaaagcttgacaggtgtgtctcctggtgatggaacgggtgacacaatgtcagacgatgaagatgac

SEQ ID NO: 1813 - DNA, 252 bp, Glycine max
gttgaatttggaagcaggtttcgaattggtttattaacgcgagggtgaggctatggaagccgatggtggaggaaatgtatctggaagaagagaaggagcaagaaaacgacgtagcatcatcggatattaatgttcccgaagaggatgagaagccaacgcaggaggctccactccttcgaattgactcagagtgcatgtcgtctatcgtcaacgacgtcacaaagagcggcaaaaccatccaaaacgacaatc

SEQ ID NO: 1814 - DNA, 236 bp, Glycine max
acggcgcaggcgccgaatccggagatttgaagggagagacggcgccggtggacggcctcttgaactggcagaatgcgagattgaaggcggagattttaacgcatcctctgtacgaacagcttctgtcggcacacgtggcgtgcttgcggatcgccacgccggtcgaccagttgcccaggatcgacgctcagctcgcacagtcccagaatgtcgtcgccaagtactctgccttcgga

SEQ ID NO: 1815 - DNA, 266 bp, Glycine max
ggaaatcttgcgcaagagaagagctgggaaacttcctggtgacacaacttctgttcttaaagcttggtggcaatcacattccaagtcgccttaccctaccgaggaggataaggcaaggttggtgcaggaaactggattgcaattaaagcagattaataattggtttatcaatcaaaggaagaggaattggcacagcaatccttcaacttcaactgtcttgaagagcaaacgcaaaaggtattcccatcaaaactagtaatttgtaa

SEQ ID NO: 1816 - DNA, 263 bp, Glycine max
gggcagagatgtttccctctatgattgctagagctatcaacctcgatgttatatctaatggcatgggtggaacaagaaatggtgctctacaagtgatgcatgctgaggttcaattgctttcgccactagttcctgtccgtcaagtaagattcatccgattctgtaagcagcatgcagaaggtgtttgggctgtggttgatgtttctattgagattggtcatgatgctgctaatgcacagccagtcatgagctgtaggaggctt

SEQ ID NO: 1817 - DNA, 158 bp, Glycine max
tgcagtcatacgtgacaacaacaacacctgatttcaactgtgtctctttacttcgagtcaatagtgcaaattcaagccaaagcaatatgctgatacttcaagagagttgcacagattctactggctcatatgtagtttatgctcctgtggatattgtt

SEQ ID NO: 1818 - DNA, 259 bp, Glycine max
accaagttgaagcagactgaagtggattgtgaatacttgaagaactgctgtgagaatctaactgaagagaataggaggcttcaaaaggaagtgcaagagcttagggcattgaagttatccccacagctttacatgaacatgaaccctcccaccactctcacaatgtgcccttcgtgcgagcgtgttgccgtctcatccacatccttttcctcatcggccaccatgccctctgccccgcctccagctaatctcaacccgg

SEQ ID NO: 1819 - DNA, 242 bp, Glycine max
actcgagccgaatcggctcgactcgaccgcttattcccacagagactgagaggaccgaatcccatgctatcaggaccatccctagcaccatcaaacagattggcatcactatctacttgttcatcttcctcatcagacattgtcgctcccgtaccttccccgggtgaaactcctgttaaactttgtaaggattgctcaatctcccaacaagccatgactgcttccattgcatggacccggac

SEQ ID NO: 1820 - DNA, 263 bp, Glycine max
ccatgctccacaacaacaacactctacgatgataacaacaaaaccagcactaacactgggttagggtacattttcatggacagtgaccaacatcaccgcaacaacaacaacaatggaagctcctcctcctcttcctcttctgctgtcaaggccaagatcatggctcatcctcactatcaccgtctcttggcagcttacgtcaattgtcagaaggttggagccccaccggaagtggtggcaaggttagaagaagcatgtgcttc

SEQ ID NO: 1821 - DNA, 264 bp, Glycine max
  unsure (1)..(264): unsure at all n locations
gatcagtctagcgctgacgggcatgacatgatgggatttggtccattgcttcctacagaatctgaaaggtccctgatggaaagagttcgtcaggagcttaagattgagctcaagcagggttttaagtcaagaattgaagatgttagggaggaaatattaaggaagcggagagctgggaaattaccaggtgacacaacatcggttttaaaggcctggtggcagcaacatgctaagtggccctacccaactgnagatgacaaggca

SEQ ID NO: 1822 - DNA, 277 bp, Glycine max
  unsure (1)..(277): unsure at all n locations
ttgaacagctcctacatgaatggatggtagtttcgatcgattttggacggtctcgtcgaggaagggtgtgtcgaagaaacgggagtttaatctgagaagaagcgtcgactaagtgtggaacaagtgaatgctttggagaagaactttgaggttgaaaacaagcttgaacctgagaggaaggtcaagcttgcccaagaactagggttgcaacctagacaagtagccgattggttccaaaaccgccgagccatctggaaaaccanacaattggagagag

SEQ ID NO: 1823 - DNA, 279 bp, Glycine max
aaaggggtggctctgatgatgatagcaatgagaataacaacaacaacaataacggaagcagtggcaagattgtgaattctaatgaggggcagagcaagcccaagcgccagatgaaaaccccttttcagcttgaaaccctcgagaaggcttatgctgtggataattacccttcggagacgatgagggtggagctgtctgagaaattggggttgtcagatcgacagcttcagatgtggttctgccacaggaggttgaaggacaagaaggacttgccgtcta

SEQ ID NO: 1824 - DNA, 266 bp, Glycine max
gggaacgctactacttctgagatgcgtgttggatcaacggctaattgttgttacctgcagctggaagctcctcaacagaataatgtaaccgagtcatcatcagatatgtcagatcggatgatcaagatccagatcgcaaatcaccctctttatccagatttactctctgcatatatagaatgccaaaaggttggagcaccgccggaactggcatgccttcttgaagaaataggccgagaaagccaccgcatgaatgctcgccgtga

SEQ ID NO: 1825 - DNA, 253 bp, Glycine max
atgcacttcaatttcagaaccaaaaacttcagactgagatattggcactgaaaagcagagaaccaactgaatccatcaacctcaacaaagaaactgagggatccagcagcaatagaagtgagaacagctcagagattaagttggatatctcaagaacaccagctattgatagtcctctatccactcagcagaacaacagcaacagaacactctttccatcttctgctagaccaacaggagtggctcagctttt

SEQ ID NO: 1826 - DNA, 268 bp, Glycine max
actcgagccgaatcggctcgagacggctgcgagaagacgacagaagagggacaaaaggaaaggcagaaatgcaagaaccaagcttgggattgatgggtgaggtctccggcgatcaccaccgtcagctgaaggcggagataacgactctccgctgaacgagcacttctggcagcacacgtggcatgcctccgtgtggccaccccgatcgacaagcttccactcatcgatgctcgtgtatctcagtctcacaacttctacgctcttatgt

SEQ ID NO: 1827 - DNA, 281 bp, Glycine max
cgggttgaagtttggtttcagaacagaagagcaaggaccaagctgaagcaaacagaggtggattgcgagttcctgaagaaatgttgtgagaaactgaccgatgagaatctaaggctgaagaaggagttgcaagagctgcgtgcacaaaagcttggatcaacaccactgtacattcaactctccaaggccacaacttgagcatttgttcatcgtgcgagaaactgttgaagcccaatgaagggaacaaaggagccattaacaaattgcagaacagtatagag

SEQ ID NO: 1828 - DNA, 277 bp, Glycine max
tacggctgcgagaagacgacagaaggggcagaaggtgtatgggctgtagttgatgtttccattgagataggtcacgatgctgctaatgcacagccatccattagctgtagaaggcttccttctggctgtattgtgcaggatatgccgaatggttactccaaggttacttggcttgagcattgggagtacgatgagaatgttgtccaccaactttatcgcccgttgctaagttctggtgttggattcggtgctcatagatggattgccaccctccaaa

SEQ ID NO: 1829 - DNA, 266 bp, Glycine max
ttgcagccaagacaagttgccatatggtttcagaatagaagggccagatggaaaaccaagcatttggagaaggaatatgaagtcctcaagaaacagtttgaagcagtcaaggccgataatgatgttcttaaggttgagaaccagaaactacaggcagagttacaagctgtaaaaagtagggattggtgtgaagctggaatgatgagccataagaaagaaactgagggttcatggagcaatggaagtgataacagtttagagattaa

SEQ ID NO: 1830 - DNA, 240 bp, Glycine max
ggaaaactgattttgtgggtctctaatgttttgtactagtttgacccttcgtctttgttttgggtttcggagcatgacctggtttagttagttagaggtttttttagtttgtaatacttactgcgttactctcatttctcatgattaaatcggagattctggtaaagtcagtagtctaaataaatataatatattacatatagaaaaaaaagcacgtgaggtggacgagcccggaagtgg

SEQ ID NO: 1831 - DNA, 256 bp, Glycine max
ggagtggaggcggacattaacttcaacattgaagattatgaagatgacttgaagcagatgagcaatcttaccaaggaagagttcgtgcacgtgcttcgccgacaaagcactggatttccgagagggagttccaagtatcgaggtgtcactttgcacaagtgtggaagatgggaggctcgaatgggccaatttttagggaaaaagtacgtttatttgggtctcttcgacactgagatcgaagctgcaagggcttatg

SEQ ID NO: 1832 - DNA, 267 bp, Glycine max
tgaaataacagtactagtctgatgcgatcataaccctagatgtcttcacaacccgaggccgcttgtctgagtatgccaacaacagtgttaaggccaccattgaaaggtacaagaaggcagatgctgctgcttcaaacacagaatccgtaactgaagctaacacacagttttaccagcaagagtcaaccaaattgagaagacaattcgagatattcagaatctaaacaggcacatccatggtgaaacattggttctctgagtctcaag

SEQ ID NO: 1833 - DNA, 194 bp, Glycine max
tctcgagccgctcgagccgcaatgctgcaacttctttttggcttcctgtgtcaccaaaaagggtttttgaattcctccgcgatgagaactccagaagtgagtgggatattctttccaacggtggagttgtccaagaaatggcacacattaccaatggccgagacactggaaattgtgtctccctacttcgtgtg

SEQ ID NO: 1834 - DNA, 242 bp, Glycine max
gagctgggaaattaccaggtgacacaacatcggtttcaaaggcctggtggcagcaacatgctaagtggccctacccaactgaagatgacaaggcaaaacttgtggaggagacagggttgcagctgaagcaaacaataattggttcatcaatcaaaggaaacgcaactggcacagcaactctcaatcggttaactctctgaagtccaagcgcaagagagagtatgcccactaaggattccagt

SEQ ID NO: 1835 - DNA, 251 bp, Glycine max
tctccttcctgttctgctaagtggcaaagaaagaaagaaagaaaatttcaagggctgaaacatctatctttaactgtattctccctttgtttcctcaccagttgattcaggttgcaaacatggcttttccagacccatccatgtcagtttctccacagaggaagatgggaagggggaagattgagatcaagaggattgagaacactaccaatcgccaagtcacattctgcaagcgcaggaacggcttgctc

SEQ ID NO: 1836 - DNA, 243 bp, Glycine max
caactgcagaaagacaagaaattcagatgaagaaagccaaactaatcggtatgcttgatgaggtggagcaaaggtacaggcagtaccagcagcagatggagatagtggtttcatcgtttgagcaagctgcggggattggttctgcgaggacttacactgcccttgcattgcaaacaatttcgaagcagtttcggtgtttgaaagatgcgattgcagggcaagttcgaactgcgaataagagct

SEQ ID NO: 1837 - DNA, 240 bp, Glycine max
aagaaattcaaatgaagaaagccaaactaattggcatgcttgatgaggtggagcaaaggtacaggcagtaccaccagcagatggagatagtgggttcatcatttgagcaagctgcggggattggttcagcaaggacttacactgcccttgcattgcaaacaatctcgaagcagtttcggtgcttgaaagatgcaattgcagggcaggttcgcactgcgaataagagcttaggagaagaag

SEQ ID NO: 1838 - DNA, 238 bp, Glycine max
aagaaattcaaatgaagaaagccaaactaattggcatgcttgatgaggtggagcaaaggtacaggcagtaccaccagcagatggagatagtgggttcatcatttgagcaagctgcggggattggttcagcaaggacttacactgcccttgcattgcaaacaatctcgaagcagtttcggtgcttgaaagatgcaattgcagggcaggttcgcactgcgaataagagcttaggagaaga

SEQ ID NO: 1839 - DNA, 245 bp, Glycine max
cagaaagacaagaaattcaaatgaagaaagccaaactaattggcatgcttgatgaggtggagcaaaggtacaggcagtaccaccagcagatggagatagtgggttcatcatttgagcaagctgcggggattggttcagcaaggacttacactgcccttgcattgcaaacaatctcgaagcagtttcggtgcttgaaagatgcaattgcagggcaggttcgcactgcgaataagagcttaggagaa

SEQ ID NO: 1840 - DNA, 262 bp, Glycine max
aaaccgtcgtgccagatggaagacaaagcaattggaaagagattacggcgtcctcaaagccaattatgaatcacttaaacttaactacgacaccctccaacaagaccacgaagccttactcaaagagataaaggaattgaaatcgaggctggtgcaagaagagaacaacaacaacactgaaagcgatgtttcggtgaaggaagagatgctgaccaccacgctctgtgaaaccgccattcctggatcggacacgaaggagttg

SEQ ID NO: 1841 - DNA, 265 bp, Glycine max
agagattacggcgtcctcaaagccaattatgaatcacttaaacttaactacgacaccctccaacaagaccacgaagccttactcaaagagataaaggaattgaaatcgaggctggtgcaagaagagaacaacaacaacactgaaagcgatgtttcggtgaaggaagagatgctgaccaccacgctctgtgaaaccgccattcctggatcggacacgaaggagttggttacgagtgttttaacaagagtgatgaggtgggaggggg

SEQ ID NO: 1842 - DNA, 429 bp, Glycine max
  unsure (1)..(429): unsure at all n locations
cccacgcgtccgcccacgcgtccgtccacgcgtccgctcgaacctgaccgaaagttgaagctggcacaagaacttggcttgcaaccaagacaagttgcggtttggttccaaaaccgtcgtgccagatggaagacaaagcaattggaaagagattacggcgtcctcaaagccaattatgaatcacttaaacttaactacgacaccctccaacaagaccacgaagccttactcaaagagataaaggaattgaaatcgaggctggtgcaagaagagaacaacaacaacactgaaagcgatgtttcggtgaaggaagagatgctgaccaccacgctctgtgaaaccgncattcctggatcgtacacgaaggatttgagttacgagtggtttaaacaggagtgataagggtggaggggtttcttctgtgttcca

SEQ ID NO: 1843 - DNA, 242 bp, Glycine max
gaagagacttagcagctcagattcttccagtgccctcatgacaatttgtccatcaacagaggaacatagtccgaggaacagccaacacatgtatggtagggagttccaattcgatgttggacggactcgacgaggaagggtgtgttgaagaaccggggtatcaatctgagaagaagcgtcgtctaagtgtggatcaagtgaaggctttggagaagaactttgaggttgaaaacaagcttgaa

SEQ ID NO: 1844 - DNA, 226 bp, Glycine max
ggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagaacttgggttgcaacctagacaggtagccgt

SEQ ID NO: 1845 - DNA, 246 bp, Glycine max
ctcgagccgtgacaatttttccatcatcatcaacagaggaacatagtccgaggaacagccaccacatgtatggcagggagttccgatcgatgttggacggactcgacgaggaagggtgtgttgaagaaccggggcatcaatctgagaagaagcgtcgactaagtgtggaacaagtgaaggctttggagaagaactttgaggttgaaaacaagcttgaacctgagaggaaggtcaagcttgcccaag

SEQ ID NO: 1846 - DNA, 259 bp, Glycine max
attgactgctaacaacaataaagtggatcaatcattaaaggcttacttcttcttcttcttcttcttcttcttcttcttctaacaacaataagatcccatctttcccactcatgaagagacttaacagctcagattcttccactgccctcatgacaatttttccatcatcatcaacagaggaacatagtccgaggaacagccaccacatgtatggcagggatttccgatcgatgttggacggactcgacgaggaagggtg

SEQ ID NO: 1847 - DNA, 253 bp, Glycine max
gacaatttgtccatcaacagaggaacatagtccgaggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagaacttgggttgcaacctagacag

SEQ ID NO: 1848 - DNA, 274 bp, Glycine max
atgaagagacttaacagctcagattcttccactgccctcatgacaatttttccatcatcatcaacagaggaacatagtccgaggaacagccaccacatgtatggcagggagttccgatcgatgttggacggactcgacgaggaagggtgtgttgaagaaccggggcatcaatctgagaagaagcgtcgactaagtgtggaacaagtgaaggctttggagaagaactttgaggttgaaaacaagcttgaacctgagaggaaggtcaagcttgccc

SEQ ID NO: 1849 - DNA, 238 bp, Glycine max
acagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagaacttgggttgcaacctagacaggtagccgtatggttccaaaaccg

SEQ ID NO: 1850 - DNA, 285 bp, Glycine max
cgatcaatcattaaaggcttacttcttcttcttcttcttcttcttcttcttcttctaacaacaataagatcccatctttcccactcatgaagagacttaacagctcagattcttccactgccctcatgacaatttttccatcatcatcaacagaggaacatagtccgaggaacagccaccacatgtatggcagggagttccgatcgatgttggacggactcgacgaggaagggtgtgttgaagaaccggggcatcaatctgagaagaagcgtcgactaagtgtgg

SEQ ID NO: 1851 - DNA, 285 bp, Glycine max
ctcagattcttccagtgccctcatgacaatttgtccatcaacagaggaacatagtccgaggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagacttgggttgcaactagacaggtagccgtat

SEQ ID NO: 1852 - DNA, 275 bp, Glycine max
ggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagaacttgggttgcaacctagacaggtagccgtatggttccaaaaccgtcgagccagatggaaaaccaagcaattggggagg

SEQ ID NO: 1853 - DNA, 265 bp, Glycine max
tagtccgaggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttggggttgaaaacaagcttgaacctgagaggaaggtgaagcttgcccaagaacttgggttgcaacctagacaggtagccgtatggttccaaaaccgtcgagccagatggaaa

SEQ ID NO: 1854 - DNA, 396 bp, Glycine max
aattcggcccaagccttttgagtgaaaaaccttgtcttcccacctttctttcgaaaaatcttaaagacattgactaacaacactaaagtggatcaatcaaaagacttacttcttcgtctaacaacattaagatcacatctgtcccactcatgaagagacttagcagctcagattcttccagtgccctcatgacaatttgtccatcaacagaggaacatagtccgaggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctg

SEQ ID NO: 1855 - DNA, 230 bp, Glycine max
cgagaacagagacatgcagcagaggctcccacctccgacatggctcaacaacgttaacgcgcgtcaacagaatttcctcgacaccgagaagagcgtggatcggaacaaccgaagcgagagcaattgcgaatccgaggatttgagggaatacaaagcggacattctaggtcaccctctctacgatcaactgttgtcggcgcacgtctcgtgcctcagaatcgccacgccgg

SEQ ID NO: 1856 - DNA, 268 bp, Glycine max
gcgacaaacacacacaaacacacaactcacgcccccgcgacaatctttctccggcgacctggaattccgacgaaggtaattgcggctccttcgtcccgaaactgaggccctcaaagtataaactttggtggtggtgggaggatctgcgtggtgtatgatgggatctcgcatatgcccgttggagactccggcgaggttgctttggaccacaagcttcttccgtcataagcttatgatcttctaataattactaattcacgcacacaac

SEQ ID NO: 1857 - DNA, 345 bp, Glycine max
  unsure (1)..(345): unsure at all n locations
ctccccttgcttttcttaccatctccttcaattctctctcactctcttttttctctcaccaaaacctttcaccccaatatnctnncacnactattctgataaattgcnaatttttataaagctagctagagatgatggttcaaaaggaagatttgggtttgagtttaagcctcaacttccctcatcacaataccccaaatcctcaacatncgagtctcatgtcatcctctactcattcctcttctccttctggttgcaaccctcaaaaaccctcttggaacgaggctttcattcttcggatcgaantccgacacagcagagcgaacgcgatcgttcctgcgcgga

SEQ ID NO: 1858 - DNA, 242 bp, Glycine max
aaaacctttcacccaatatcctcaatctactacttctgataaattgctaatttttataaagctagctagagatgatggttcaaaaggcagatttgggtttgagtttaagcctcaacttccctcatcacaataccccaaatcctcaacatccgagtctcatgtcatcctctactcattcctcttctccttctggttgcaaccctcaaaaaccctcttggaacgaggctttcacttcttcgggt

SEQ ID NO: 1859 - DNA, 244 bp, Glycine max
atccaaagtctcttctgtcgttgggggttgtaaacaggaagatatcagttcagcaaggagtgacattttggattcagatagtccacattacaccgatggagttcactctgcgctgctagagcatggtgattcttcttatgtgtttgagcctgatcaatcagatatgtcacaagatgaagaagataacctcagcaagagtctctacccttcgtacctctttccaaacttgaagaagatgtggatt

SEQ ID NO: 1860 - DNA, 306 bp, Glycine max
  unsure (1)..(306): unsure at all n locations
cttaaaagctgaggtggcgagcctcaatgagaaggtgcttgncagaccggaaacaagaggggcacatgaagcagcaaggccgaaagtgaagaagaaacanaaagattattgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaatccgcactgctagagcatggtgattctt

SEQ ID NO: 1861 - DNA, 269 bp, Glycine max
attgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctct

SEQ ID NO: 1862 - DNA, 430 bp, Glycine max
tgccagaagacgacagaagggagaggggcacatgaagcacgctgaaagtgaagaagaaacaaaaagattattgcatttgcaggaacaggaaccaccccacaagcttttactggaatcagtttctgagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctctacccttcgtacctctttcccaaacttgaggaagatgtggattactccgacccgcctgaaagttcttgtaaatttggattttctgaggaagat

SEQ ID NO: 1863 - DNA, 239 bp, Glycine max
ggtcaatgccgaggaagatttgtctgatgatggatcacaagcaggggagaagaagaggaggctcaacatggagcaagtgaagacacttgagaagagctttgagttggggaacaagcttgagccagagaggaaaatgcagcttgcaagagcattggcttgcagccaagacaaattgctatatggttccagaccagaagggctaggtggaagcccaagcattggagaaagactatgatgtt

SEQ ID NO: 1864 - DNA, 266 bp, Glycine max
gacagcttcatactgtcttttgagaacatcatagtctttctccaactgcttggtcttccacctggcccttctattctggaaccatatagcaatttgtcttggttgcaagccaagtgctcttgcaagctgcatttttctctctggctcaagcttgttccccaactcaaagctcttctcaagtgtcttttcctgctccatgttgagccttctcttcttctcccctgcttgtgatccatcatcagacaaatcttcctcagcattattgg

SEQ ID NO: 1865 - DNA, 249 bp, Glycine max
atttcttgcacccttatcctaaggactccgataaggttatgcttgcaaaacaaactggacttactcggagccaggtgtctaactggtttataaatgcccgagttcggctatggaagccaatggtagaagaaatgtacttggaagaggtaaaacaagaaccaaacaatagctctcaggataacaccacaaaaagatcacaagaatcaagcaaggagttatggtcagaagctactgctactgcacaggaat

SEQ ID NO: 1866 - DNA, 244 bp, Glycine max
ctgagcgtgagaaagagaaggggaagaaagagagagagtgatgggaaggggaagagtggagttgaagagaattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgctggag

SEQ ID NO: 1867 - DNA, 251 bp, Glycine max
gaacagagagagagagagagagagataatagtagaaggtcggagatagtaaagagagaaatccgaatagaaaaagaagctagctagggtttcggcgcgaagaagaatggggaagaagaaggtggagataaagcgaatcgagaacaaaagcactcggcagataacattctccaagaggcgcaatggattgatgaagaaagctcgcgagctatccattctctgcgatgcgaaggtggcgctgctcatcttctc

SEQ ID NO: 1868 - DNA, 262 bp, Glycine max
ctcaaccccaaacagaagcaagctttagccaggcagttaaatctccggcctcgacaagttgaagtgtggttccagaatcggagagccagaacaaagctgaagcaaacggaggtggactgtgagttcttaaagaaatgctgtgaaacattgacggacgaaaacaggaggctaaagaaggagctgcaagagctgaaggcactgaaactagctcaacccttgtacatgcctatgcctgctgccacactcaccatgtgcccttctt

SEQ ID NO: 1869 - DNA, 265 bp, Glycine max
  unsure (1)..(265): unsure at all n locations
ctttagccagacggttaaatctccggcctcgacaagntgaagtgtggttccaacaatcggagagccagaacaaagctgaagcaaacggangtggactgtgagttcttaaagaaatgctgtgaaacattgaaggacgaaaacaggaggttaaagaaggagctgcaanactgaaggcactgaaactagctcaacccttgtacatgcctatgcctgctgccacatcaccatgtgcccttcttgcgacaggctcggtggcgttaagata

SEQ ID NO: 1870 - DNA, 239 bp, Glycine max
gtaatttttcccaaagctgatcgagaagccagccaggccagagttgaagaagaatgggaagggggaagatcgaaatcaaaaggattgagaacacaacaaatcggcaagtgaccttctgaagagaagaaatgggcatcagaagaaagcttatgagctgtcagtgcagtgtgatgcagaagttgcccacatcgtcatcaccagccgtggccgtcacaatgagtattccaacaacaacataa

SEQ ID NO: 1871 - DNA, 192 bp, Glycine max
tacggctgcgagaagacgacagaagggggatccaaatcaagctccagaagcgtcttctcagaagaaaatgggaagagggaagattgaaatcaaacggatcgagaacaccaccaataggcaagtcaccttctgcaagcgccgcaacggtttgctgaaaaaagcttatgaattatcagttctgtgtgatgctga

SEQ ID NO: 1872 - DNA, 259 bp, Glycine max
cttctcagaagaaaatgggaagagggaagattgaaatcaaacggatcgagaacaccaccaataggcaagtcaccttctgcaagcgccgcaacggtttgctgaaaaaagcttatgaattatcagttctgtgtgatgctgaagttgcccttgttgtcttctcaacccgtggccgtttgtatgagtatgccaacaacagtgttagggccactattgagaggtacaagaaggcaaatgctgctgcttcaaacgcagaatccgt

SEQ ID NO: 1873 - DNA, 264 bp, Glycine max
ctgctcgaggcgtcttctcagaagaaaatgggaagatggaagattgaaatcaaacggatcgagaacaccaccaataggcaagtcaccttctgcaagctccgcaacggtttgctgaaaaaagcttatgaattatcagttctgtgtgatgctgaagttgcccttgttgtgctctcaacccgtggccgtttgtatgagtatgccaacaacagtgttagggccactattgagaggtacaagaaggcaaatgctgctgcttcaaacgca

SEQ ID NO: 1874 - DNA, 278 bp, Glycine max
agaagattgaaatcaaacggatcgagaacaccaccaataggcaagtcaccttctgcaagcgccgcaacggtttgctgaaaaaagcttatgaattatcagttctgtgtgatgctgaagttgcccttgttgtcttctcaacccgtggccgtttgtatgagtatgccaacaacagtgttagggccactattgagaggtacaagaaggcaaatgctgctgcttcaaacgcagaatccgtatctgaagctaacacacagttttaccagcaagagtcatccaaa

SEQ ID NO: 1875 - DNA, 402 bp, Glycine max
  unsure (1)..(402): unsure at all n locations
agcccacgcgtcagcccacgcgtccgtacggctgcgagagacgacagaagggcaagctccagaagcgtcttctcagaagaaaatgggaagagggaagattgaaatcaaacggatcgagaacaccaccaataggcaagtcaccttctgcaagcgccgcaacggtttgctgaaaaaagcttatgaattatcagttctgtgtgatgctgaagttgcccttgttgtcttctcaacccgtggccgtttgtatgagtatgccaacaacagtgttagggccactattgagaggtacaagaaggcaaatgctgctgcttcaaacgcagaatccgtatctgaagctaacacacagttttaccagcaagagtcatccanattgagaagacaaattcgagatattcagaatct

SEQ ID NO: 1876 - DNA, 394 bp, Glycine max
acggacgcgtgggcggctgcgagaagacgacagaaggggaaatcttgtgtctattgtattttatctctttccatatgcttccaaccatggaggatccaaatcaagctccagaagcgtcttctcagaagaaaatgggaagagggaagattgaaatcaaacggatcgagaacaccaccaataggcaagtcaccttctgcaagcgccgcaacggtttgctgaaaaaagcttatgaattatcagttctgtgtgatgctgaagttgcccttgttgtcttctcaacccgtggccgtttgtatgagtatgccaacaacagtgttagggccactattgagaggtacaagaaggcaaatgctgctgcttcaaacgcagaatccgtatctgaagctaacacaca

SEQ ID NO: 1877 - DNA, 229 bp, Glycine max
catgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccacctaagagccttttccaaatggccccttaaagatcgaacttggtcggagtaaacatgg

SEQ ID NO: 1878 - DNA, 287 bp, Glycine max
  unsure (1)..(287): unsure at all n locations
caaaaactcccgttttctctctctgtttttccatggccatctgatcaaactnttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagtaaacatggcggctagtggaagttccttt

SEQ ID NO: 1879 - DNA, 190 bp, Glycine max
  unsure (1)..(190): unsure at all n locations
caaaaactcccgttttctctctctgtttttccatggccatctgatgcaaacttttcttgattctctctctcagtttttgctattctgagtgatgggtatgccctgccgctgttcccacacctnccanatcactgaaatcatcatcaccagcttcttccgncacaagtcttaaattacaacaatttccctc

SEQ ID NO: 1880 - DNA, 348 bp, Glycine max
ctcgattcttctctcttcctctctgctccttcaatttttgtttcaggttcgagatccatggtgagttttgaagcagaaggagggaaggggtgtaacggctccttcttccgcgcgtttgacatggacgacaatggggacgagtgcatggatgagtactttcataaacccgagaagaagcgtcgtctctccatgaaccaggttcagtttctggagaagagtttcgaggaggagaacaagcttgaaccggagagaaagaccaagcttgccaaagaccttggtttgcggccacggcaagttgctatttggttccagaacgtcgactcgctggaagaccaagacctggagaag

SEQ ID NO: 1881 - DNA, 274 bp, Glycine max
  unsure (1)..(274): unsure at all n locations
aacacaaacaaaaactcccgttttctctctctgtttttccatggccatctgatcaaacttttcttgattctctctctcagtttttgctattctgagtgatgggtatgccctgccgctgttcccacacctcccacatcantgaaatcatcatcaccagcttcttccgccacaagtcttaaantacaacaatttccctcaattattcatcaaccaaccaccttaatagccttttccaatggttccttaaagatccaacttggtcggagtaaacatg

SEQ ID NO: 1882 - DNA, 249 bp, Glycine max
gacactcccttcccatctaagcttcttattataaacccaaggcagagtctcctctttctccgaactccaaaacacaaacaaaaactcccgttttctctctctgtttttccatggccatctgatcatacttttcttgattctctctctcagtttttgctattctgagtgatgggtatgccctgccgctgttcccacacctcccacatcattgaaatcatcatcaccagcttcttccgccacaagtcttaa

SEQ ID NO: 1883 - DNA, 263 bp, Glycine max
ctcgagccgctgtttttccatggccatctgatcaaacttttcttgattctctctctcagttattgctattctgagtgatgggtatgccctgccgctgttcccacacctcccacatcactgaaatcatcatcaccagcttcttccgcacaagtcttaaattacaacaatttccctcaattattcatcaaccaaccaccttaatagccttttccaatggttccttaaagatccaacttggtcggagtaaacatggcggctagtgg

SEQ ID NO: 1884 - DNA, 248 bp, Glycine max
ctaacacatacaaacatagtaaccgcttctctctctttctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttc

SEQ ID NO: 1885 - DNA, 251 bp, Glycine max
ccgcttctctctctttctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaaatggccccttaaagatcgaact

SEQ ID NO: 1886 - DNA, 246 bp, Glycine max
caaaactcccgttttctctctctgtttttccatggccatctgatcaaacttttcttgattctctctctcagattttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaa

SEQ ID NO: 1887 - DNA, 263 bp, Glycine max
catctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaaatggcccctaaagatcgaacttggtcggagtaaacatggcgggtagtggaagtgccttttccaacatcactagctttct

SEQ ID NO: 1888 - DNA, 253 bp, Glycine max
caaacatagtaaccgcttctctctctttctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaatggccccttaaa

SEQ ID NO: 1889 - DNA, 260 bp, Glycine max
gtaaaactcccgttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagta

SEQ ID NO: 1890 - DNA, 256 bp, Glycine max
atacaaacatagtaaccgcttctctctctttctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccactttaagagcctttcccaaatggccccttaa

SEQ ID NO: 1891 - DNA, 241 bp, Glycine max
ctagcttccttcgcaaccaacaaccctcttcccaacctctcgattcttctctcttcctctctgctccttcaatttttgtttcaggttcgagatccatggtgagttttgaagcagaaggagggaagggggtaacggctccttcttccgcgcgtttgacatggacgacaatggggacgagtgcatggatgagtactttcataaacccgagaagaagcgtcgtctctccatgaaccaggttcag

SEQ ID NO: 1892 - DNA, 270 bp, Glycine max
caaaaactcccgttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagtaaacatggcgg

SEQ ID NO: 1893 - DNA, 260 bp, Glycine max
cccgttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagtcaacatggc

SEQ ID NO: 1894 - DNA, 213 bp, Glycine max
  unsure (1)..(213): unsure at all n locations
catgtncaatnctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaaatggccccttaaagatcgaac

SEQ ID NO: 1895 - DNA, 186 bp, Glycine max
  unsure (1)..(186): unsure at all n locations
catgtccatctgataaccctttcctgattctctttcgtggttgtngctattctgagtgatgggtatgccctgccgctgttcccacacctcccacatcactgaaatcatcatcaccagcttcttccgccacaagtcttagatcaacaatttccgtcaattattccaaaaccaccttaagagcctttt

SEQ ID NO: 1896 - DNA, 190 bp, Glycine max
cacatacaaacatagtaaccgcttctctctctttctctctctctctctctctttttccatgtccatctgataaccctttcctgattctctttcgtggttgttgctattctgagtgatgggtatgccctgccgctgttcccacacctcccacatcactgaaatcatcatcaccagcttcatccgccacaag

SEQ ID NO: 1897 - DNA, 242 bp, Glycine max
caaacatagtaaccgcttctctctctttctctctctctctctctctttttccatgtccatctgataaccctttcctgattctctttcgtggttgttgctattctgagtgatgggtatgccctgcctgtcccacacctcccacatcactgaaatcatcatcaccagcttcttccgccacaagtcttagatcaacaatttccgtcaattattccaaaaccaccttaagagccttttccaaatgg

SEQ ID NO: 1898 - DNA, 240 bp, Glycine max
ccaaaacacaaacaaaaactcccgttttctctctctgtctttccatggccatctgatcaaacttttcttgattctctctctcagtttttgctattctgagtgatgggtatgccctgccgctgttcccacacctccacatcactgaaatcatcatcaccagcttcttccgccacaagtcttaaattacaacaatttccctcaattattcatcaaccaaccaccttaatagccttttccaat

SEQ ID NO: 1899 - DNA, 249 bp, Glycine max
gttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagta

SEQ ID NO: 1900 - DNA, 273 bp, Glycine max
tgagttttgaaggagaaggagggaaggggtgtaacggctccttcttccgcgcgtttgacatggacgacaatggggatgagtgcatggacgagtactttcatcaacccgagaagaagcgacgtctctctgcgagccaggttcagtttctagagaagagcttcgaggaggagaacaagcttgaacccgagagaaagaccaaactagccaaagaccttggtttgcagccacggcaagttgctatttggttccagaaccgtagagctcggtggaaga

SEQ ID NO: 1901 - DNA, 259 bp, Glycine max
atacaaacatagtaaccgcttctctctctttctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaaatggccccttaaaga

SEQ ID NO: 1902 - DNA, 257 bp, Glycine max
cacaaacaaaaactcccgttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttcaaatggttcctgaaagatccaacttg

SEQ ID NO: 1903 - DNA, 276 bp, Glycine max
aaaaactcccgttttctctctctgtttttccatggccatctgatcaaacttttcttgattctctctctcagttttcgctattctgagtgatgggtatgccctgccgctgttcccacacctcccacatcactgaaatcatcatcaccagcttcttccgccacaagtcttaaactacaacaatttccctcaattattcatcaaccaaccaccttaatagccttttccaatggttccttaaagattcaacttggtcggagtaaacatggcggctagtgg

SEQ ID NO: 1904 - DNA, 266 bp, Glycine max
ggaaggggtgtaacggctccttcttccgcgcgtttgacatggacgacaatggggacgagtgcatggatgagtactttcataaacccgagaagaagcgtcgtctctccatgaaccaggttcagtttctggagaagagtttcgaggaggagaacaagcttgaaccggagagaaagaccaagcttgcaaaagaccttggtttgcggccacggcaagttgctatttggttccagaaccgtcgagctcgctggaagaccaagacgctggag

SEQ ID NO: 1905 - DNA, 305 bp, Glycine max
agacgacagaagggggaactccaaaacacaaacaaaaactcccgttttctctctctgtttttccatggccatctgatcaaacttttcttgattctctctctcagtttttgctattctgagtgatgggtatgccctgccgctgttcccacacctcccacatcactgaaatcatcatcaccagcctcttccgccacaagtcttaaattacaacaatttccctcaattattcaccaaccaaccaccttaatagccttttccaatggttccttaaagatccaacttggtcggagtaaacatggcggcta

SEQ ID NO: 1906 - DNA, 409 bp, Glycine max
caaaaactcccgttttctctctctgtttttccatggccatgtgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagtaaacatggcggctagtggaagttccttttccaacatcactagcttccttcgcaaccaacaaccctcttcccaacctctcgattcttctctcttcctctctgctccttcaatttttgtttcaggttcgagatccatggtgagttgtgaagc

SEQ ID NO: 1907 - DNA, 423 bp, Glycine max
agcccacgcgtccgcccacgcgtccgtacggatgcgagaagacgacagaaggggactccacaacacaaacaaaaactcccgttttctctctctgtttttccatggtcatctgatcaaacttttcttgattcactctctcagtttttgctattctgagtgatgggtatgccctgccgctgttcccacacctcccacatcactgagatcatcatcatcagcttcttccgccacaagtctgaaattacaacaatttccctcaattattcatcaaccaatcaccttaaaaaccttttccaatggatccctaaagattcaacttggtcagagtaaacatggcggctaatggaaattccttttccaacatcactagctttccttcgcatccaacatacctcttaccaacctctcgattcttctcacttc

SEQ ID NO: 1908 - DNA, 348 bp, Glycine max
cccacgcgtccgtacggctgcgcgaagacgacagaaggggggaagaacgaagcctcctcgttcttcttcttctgcgctttctctctccctctctagaaccgtaaccgtcgtttctttctttctctctcctcaaccagagataaagagtcaccttcttatttttctgaatctcgcggcgttgttctttctgctgctgcggctgtggttccggcggcgatgggacagcaatcgttgatctacagcttcgtcgctcgaggcaccgttatcctcgcggagtacaccgagttcaccggaaacttcaccggcgtggcggcgcagtgcctccagaaactccctttctccaacaac

SEQ ID NO: 1909 - DNA, 259 bp, Glycine max
gttccagaaccgtagagctcggtggaagaacaaacagctggagaaggattacgagactctgcatgcaagttttgagagtctcaagtccaactatgactgtctcctcaaggagaaagacaagttaaaagctgaggtggcgagcctcactgagaaggtgcttgcaagagggaaacaagaggggcacatgaagcaggctgaaagtgaaagtgaagaaacaaaaggattattgcatttgcaggaacaggaaccaccccagagg

SEQ ID NO: 1910 - DNA, 242 bp, Glycine max
gaaccgtcgagctcgctggaagaccaagacgctggagaaggattacgaggctctgcatgcaagtttagagaatcttaagtccaactatgacagcctcctcaaggagaaagacaacttaaaagctgaggtggcgagcctcaatgagaaggtgcttgcaagagggaaacaagaggggcacatgaagcagcaggctgaaagtgaagaagaaacaaaaagattattgcatttgcaggaacaggaac

SEQ ID NO: 1911 - DNA, 259 bp, Glycine max
  unsure (1)..(259): unsure at all n locations
gcttcgaggaggagaacaagcttgaacccgagagacagaccanaccagccaaagaccttggtttgcagccacggcaagttgctatttggttccagaaccgtagagctcggtggaagaacaaacagctggagnaggattacgagactctgcatgnccgttttgagagtctcaagtccaactatgactgtctcctcaaggagaaagacaagttaaaagctgaggtggcgagcctcactgagaaggtgcttgccagagggaa

SEQ ID NO: 1912 - DNA, 258 bp, Glycine max
ccgacgtctctctgcgagccaggttcagttcctagagaagagcttcgaggaggagaacaagcttgaacccgagaccaagaccaaactagccaaagaccttggtttgcagccacggcaagttgctatttggttccagaaccgtagagctccgtggaagaacaaacagctggagaaggattacgagactctgcatgcaagttttgagagtctcaagtccaactatgactgtctcctcaaggagaaagacaagttaaaagc

SEQ ID NO: 1913 - DNA, 344 bp, Glycine max
  unsure (1)..(344): unsure at all n locations
tagagaagagcttcgaggaggagaacaagcttgaacccgagagaaagaccaaactagccaaagaccttggtttgcagccacggcaagttgctatttggttccagaaccgtagagctcggtggaagaacaaacagctggagaaggattacgagactctgcatgcaagttttgagagtctcaagtccaactatgactgtctactcaaggagaaagacaagttaaaagctgaggtggcgagcctcactgagaaggtgcttgcaagagggaaacaagaagggcacatgaagcangctgaaagtgaaagtgaagaaacaaaaggattattggatttgcaggaacaggaa

SEQ ID NO: 1914 - DNA, 276 bp, Glycine max
ataatttcggtgtttgaaggatgcaataacggggcaaatcagagctgcaaacaagagtttgggagaagaggattgttttggtgctaaaattgaaggatctaggctcaaatatgtggaccatcatctaaggcaacagagggctattcagcaactgggcatgatccatcacaatgcttggagaccccagagaggattgccagagagatcggtttctgttctgcgtgcttggctctttgaacactttcttcatccttaccccaaggactcagacaagca

SEQ ID NO: 1915 - DNA, 250 bp, Glycine max
gtgctgtttcctccttctccagtggcagggtcaagagggagagggatctcagctgtgaagaagttgtggatgcaaaagagattgatcagagggatcttagctgtgaaggaataataagagccaccgaagaagaagaagacggcgccgccaccagaaagaaacttaggctcaccaaagaacaatctgctttgctagaagaaagcttcaaacaacatagcaccctcaatcctaaacagaagcaagctttgtc

SEQ ID NO: 1916 - DNA, 238 bp, Glycine max
agaaatgcaagaaccaagcttgggattgatgggtgaggtctccggcgatcaccaccgtcagctgaaggcggagataacgactcatccgctgtacgagcagcttctggcagcacacgtggcatgcctccgtgtggccaccccgatcgaccagcttccactcatcgatgctcacttatctcagtctcaccatcttctacgctcttatgtctcacacaacactcattctctctcccctcat

SEQ ID NO: 1917 - DNA, 243 bp, Glycine max
agaaatgcaagaaccaagcttgggattgatgggtgaggtctccggcgatcaccaccgtcagctgaaggcggagataacgactcatccgctgtacgagcagcttctggcagcacacgtggcatgcctccgtgtggccaccccgatcgaccagcttccactcatcgatgctcacttatctcagtctcaccatcttctacgctcttatgtctcacacaacactcattctttctcccctcatcaccg

SEQ ID NO: 1918 - DNA, 240 bp, Glycine max
aagagatgcaagaagcaggcttgggaatgatgggtgaggtctccggcgatcagcaccgtcagctgaaggcggagatagcgactcatccgctgtacgagcagcttctggcagcacacgtggcatgcctccgtgtggcgactcccatcgatcagcttccactcattgatgctcaattatctcagtctcaccatcttctacgctcttatgtctcacacaacactctttctctctcccctcatc

SEQ ID NO: 1919 - DNA, 366 bp, Glycine max
acgcgtccgacagctgcgagaagacgacagaagggggcctttgaggaaaagaaaggcagatatgcaagaatcatgcttgggaatgattggtgaggtctccggcgatcagcaccgtcagctgatagcggagatagcgactcatccgctgttcgagcatcttctggcagcacacgtggcatgcctccgtgtggcgactcccatccatcagcttccactcattgatgctcaattatctcagtctcaccatcttctacgctcttacgtctcacacaacactctttctctctctcctcatcaccgccaagaacttgacagcttcctggcacaatatttgataattttgtgtacatttaaagaacagcttca

SEQ ID NO: 1920 - DNA, 446 bp, Glycine max
gtccgacaactgcaagaagacgacagaacggggcctttgaggaaaagaaaggaagagatgcaagaagcaggcttgggaatgatgggtgaggtctccggcgatcagcaccgtcagctgaaggcggagatagcgactcatccgctgtacgagcagcttctggcagcacacgtggcatgcctccgtgtggcgactcccatcgatcagcttccactcattgatgctcaattatctcagtctcaccatcttctacgctcttatgtctcacacaacactctttctctctcccctcatcaccgccaagaacttgacaacttcctggcacaatatttgatagttttgtgtacatttaaagaacagcttcagcaacatgtcagagtccacgccgtcgaggctgtcatggcctgccgtgatatcgaaaataccttacaagctctcactggagtgag

SEQ ID NO: 1921 - DNA, 459 bp, Glycine max
aattatcgggctcgagcacgcgtcaggcggaagacgacagaagggggcctttgaggaaaagaaaggaagagatgcaagaagcaggcttgggaatgatgggtgaggtctccggcgatcagcaccgtcagctgaaggcggagatagcgactcatccgctgtacgagcagcttctggcagcacacgtggcatgcctccgtgtggcgactcccatcgatcagcttccactcattgatgctcaattatctcagtctcaccatcttctacgctcttatgtctcacacaacactctttctctctccctcatcaccgccaagaacttgacaacttcctggcacaatatttgatagttttgtgtacatttaaagaacagcttcagcaacacgtcagagtccacgccgttcaggctgtcactggctgccgtgatatccaaaataccttacaagctctcactggagtgag

SEQ ID NO: 1922 - DNA, 335 bp, Glycine max
  unsure (1)..(335): unsure at all n locations
ggtggcggggaatggtgctgcgacagtgtactcagctttggcgttgaaggccatgtcgagatgatttcaggtgtttgaaagatgggattttgtcgcatattcaggcaacaagagnagccagnggattgtgagacccaggtgcaccaggcacaacaaggggcgaaaggccaagacttaagtcattgaccaaacactgagacaacaaagggcgtttcagcaaatgagcatgatggaaacacatccttggagaccccaacgtggccttccagagcgtgccgtttcagttcttcgggcttggctctttgaacattttctccatccgtacccaagcgatg

SEQ ID NO: 1923 - DNA, 231 bp, Glycine max
gggcgaaacgccaagacttaaagtcattgaccaaacactgagacaacaaagggcgtttcagcaaatgagcatgatggaaacacatccttggagaccccaacgtggccttccagagcgtgccgtttcagttcttcgggcttggctctttgaacattttctccatccgtacccaagcgatgttgataagcatattttagcacgccaaaccggtctctcgagaggccaggtttc

SEQ ID NO: 1924 - DNA, 256 bp, Glycine max
ctcgagccggttcgagctgtggaggaggggagaataataataataatgatggaggcaaacaaggagttgaactcagcacagcacagagacaagagcttcagatgaagaagtcaaaacttgtgaccatgctagatgaggtggagcaaaggtaccgacagtatcaccaccaaatgcaagttgtgataacatcatttgagcaagcagcgggtgttggagctgcaaagtcttacacagcccttgcgttaaagacaatctc

SEQ ID NO: 1925 - DNA, 276 bp, Glycine max
gatgaaagggaatattgaatccacttctggggttggcgatggttcgagctgcggaagggagaataatgatcgagccaaacaaggagttgaactcagcacagcacagagacaagagcttcagatgaagaagtccaagcttgtgaccatgctcgatgaggtggagcaaaggtacagacagtatcaccaccaaatgcaagttgtgctaacatcgtttgagcaagcagcgggtgttggtgcggcaaagtcttacacggcccttgccttgaagacaatctc

SEQ ID NO: 1926 - DNA, 281 bp, Glycine max
  unsure (1)..(281): unsure at all n locations
gatcgagctgctattaagttcaggggagttgatgctgatatcantttcaatntgagtgattangaggatgatcttaaacagatgaagaatttgtccanggaggaattcgtacatatactgcgtcgccaaagtactggtttctcaagaggaagttctaaatanccgaggagtaacactccacaagtgtggccggtnggaagctcgaatgggacaattccttggcaaaaagtgaggacatatttttatatatnaacttaagtagtgatctactgtggttatnc

SEQ ID NO: 1927 - DNA, 226 bp, Glycine max
cagcaataagttcaggtggaaggagaagcatgttgaagctggcacagcgcatgacgaacaacttctgtgctggtgtgtgtgcctcaacagtgcacaagtggaacaagctgaacgcgggaaacgtgggggaggacgtgagggtgatgacgaggaagagcgtggatgaccccggtgaaccgccggggatcgtcctcagtgccgccacctcggtgtggcttcccgtctc

SEQ ID NO: 1928 - DNA, 230 bp, Glycine max
cagcaataagttcaggtggaaggagaagcatgttgaagctggcacagcgcatgacgaacaacttctgtgctggtgtgtgtgcctcaacagtgcacaagtggaacaagctgaacgcgggaaacgtgggggaggacgtgagggtgatgacgaggaagagcgtggatgaccccggtgaaccgccggggatcgtcctcagtgccgccacctcggtgtggcttcccgtctcgcca

SEQ ID NO: 1929 - DNA, 227 bp, Glycine max
gctgatgtcgagttcatgcaaaagcgggaaattgagctgcaaaaccacaataattatctgcgagctaagatagctgaacatgagagagctcaacaacagcaatcaaatatgatgtcaggaacactgtgcgagtcccttccttcacaatcatacgacaggaattttttccctgtaaatctcatagcttctgatgatcaccaacaatattctagtcaagaccacatgct

SEQ ID NO: 1930 - DNA, 286 bp, Glycine max
agaacacaacgaataggcaagttaccttctgcaaacgccgtaacggattgctgaagaaggcttatgaattgtctgttctgtgtgatgctgaggttgctcttgttgtcttctcaagccgtggacgcctctatgagtatgccaacaacagtgttagagggactatcgaaaggtacaagaaagcatgtgctgcttccacaaatgcagaatctgtctctgaagctaatacacagttctatcagcaggaagcgtccagattaaaaagacaaatcagagacgttcagaatct

SEQ ID NO: 1931 - DNA, 271 bp, Glycine max
ctgcaaacgccgtaacgggttgctcaagaaggcttatgaattgtctgttctgtgtgatgctgaggttgctcttgttgtcttctcaagccgtggacgcctctatgagtatgccaacaacagtgttagaggaacgatcgataggtacaagaaagcatgtgctgcctccacaaatccagaatctgtctctgaagctaatacacagttttatcagcaggaagcgtccaaattaaaacgacaaatcagagacattcagaatctaaacaggcacatc

SEQ ID NO: 1932 - DNA, 286 bp, Glycine max
  unsure (1)..(286): unsure at all n locations
ctaagtttgagcttccctctcctctcctcttctccttccagccacaaccctcaganaccctcttggaacgaccctattttcacttcttcaggtgaagctggatcattcctccgcggaatcgatgtgaaccgtttaccttctgtggttgattgcgaagaggaagcaggtgtttcatctccaaacagcacggtttctagcgtcagtggaaagcgcagntngagggaaaccaatggagaagaaaacgacacagacagagcttgttccagaggcatcatcagcgacgaag

SEQ ID NO: 1933 - DNA, 81 bp, Glycine max
ggttcaaaaggaagatttgggcttgagtctaagtttgagcttccctctcctctcctcttctccttccagccacaaccctca

SEQ ID NO: 1934 - DNA, 217 bp, Glycine max
tggaacgaccctattttcacttcttcaggtgaagctggatcattcctccgcggaatcgatgtgaaccgtttaccttctgtggttgattgcgaagaggaagcaggtgtttcatctccaaacagcacggtttctagcgtcagtggaaagcgcacgcgagggaaaccaatggagaagaaaacgacacagacagagcttgttccagaggcatcatcagcga

SEQ ID NO: 1935 - DNA, 270 bp, Glycine max
tggaacgaccctattttcacttcttcaggtgaagctggatcattcctccgcggaatcgatgtgaaccgtttaccttctgtggttgattgcgaagaggaagcaggtgtttcatgtggaaacagcacggtttctagcgtcagtggaaagcgcacgtgagggaaaccaatggagaagaaaacgcacagacagagcttgttccagaggcatcatcagcgacgaaggtgatgctgaaacctctagaaagaaacttagactctccaaaggtcagtc

SEQ ID NO: 1936 - DNA, 244 bp, Glycine max
gacggttcaaaaggaagatttgggcttgagtctaagtttgagcttccctctcctctcctcttctccttccagccacaaccctcaacaactctcttggaacgaccctattttcacttcttcaggtgaagctggatcattcctccgcggaatcgatgtgaaccgtttaccttctgtggttgattgcgaagaggaagcaggtgtttcatctccaaacagcacggttctcagcgtcagtggaaagcgc

SEQ ID NO: 1937 - DNA, 256 bp, Glycine max
  unsure (1)..(256): unsure at all n locations
caagttgtaatatttgtggggtaaaagccatgattcagataattggggcttgctgacataaaggcatgattgaactctccactcctttctatataatcccttccacacgcacttctccacttcatagtcacaactagagatgacggttcaaaaggaagatttgggcttgagtctaagtttgagcttccctctcctctcctcttctccttcagcncacaaccctcagaaaccctcttggaacgaccctattttcact

SEQ ID NO: 1938 - DNA, 253 bp, Glycine max
  unsure (1)..(253): unsure at all n locations
gacggttcaaaaggaagatttgggcttgagtctaagtttgagcttccctctcctctcctcttctccttccagccacaaccctcagaaaccctcttggaacgaccctattttcacttcttcaggtgaagctggatcattcctccgcggaatcgatgtgaaccgtttaccttctgtggttgattgcgaagaggaagcaggtgtttcatctccaaacagcacggtttctagcgtcagtggaaagcgcacangaggg

SEQ ID NO: 1939 - DNA, 297 bp, Glycine max
gttgcgtattagaccatagtctttttgtcattgttgtttcccaacaacgcagtttagcctttgagagcatcagcaatcacatggtgatcagaatatcattcagcaattgaagatcagtggcatcaggcataggctagcaagcaatgatatggctttcttcccagcaaatttcatgctacaaacacctcaccaagatgaccatcaacctccaccttcactcaactcaattataacttcatgtgcacctcaagagtaccatggtggaggagcatcctttcttggcaagagatctatgtc

SEQ ID NO: 1940 - DNA, 247 bp, Glycine max
ggcaagcatagactagcaatgatatggctttcttcccagcaaatttcatgctacaaacacctcaccaagatgaccatcaacctccaccttcactcaactcaattataacttcatgtgcacctcaagagtaccatggaggagcatcctttctaggcaagagatctatgtcattttcagggattgagcttggagaagaagctaatgctcgaggaagatttgtctgatgatggatcacaggctggagaga

SEQ ID NO: 1941 - DNA, 272 bp, Glycine max
caaagtttagcctttgagcatcagcaatcacatggtgatcagaatatcattcagcaattgaagatcagaggcaagcatagactagcaatgatatggctttcttcccagcaaatttcatgctacaaacacctcaccaagatgaccatcaacctccaccttcactcaactcaattataacttcatgtgcacctcaagagtaccatggaggagcatcctttctaggcaagagatctatgtcattttcagggattgagcttggagaagaagctaat

SEQ ID NO: 1942 - DNA, 284 bp, Glycine max
gttgaactgtatgatgaaagagtattatgagaagcagtccgccggagaagaagcaccgcctcagttccgaaacaggtccatctgttgggagaagagctttgaggaagagaacaaattggagcctgagaggaagacccagttggctaagaagctgggattgcagcccaggcaggtggctgtgtggtttcagaaccgcagggctcgatggaagaccaagcaacttgaaagggattatgatgttctcaatcttcatacgataccctactttcatcctatgattcaat

SEQ ID NO: 1943 - DNA, 270 bp, Glycine max
tacggctgcgagaagacgacagaaggggagaacaaattggagcctgagaggaagacccagttggctaagaagctgggattgcagcccaggcaggtggctgtgtggtttcagaaccgcagggctcgatggaagaccaagcaacttgaaagggattatgatgttctcaagccttcatacgataccctactttcatcctatgattcaattatgaaggagaatgagaaactcaaatctgaggtggtatccttaaatgaaaagcttcaagttcaa

SEQ ID NO: 1944 - DNA, 257 bp, Glycine max
aaggttggatctcagtaagaggcttggcttggagaataagcaagtcaagttctggtttcagaatcgacgaacccaaatgaagacccaactggaacgccatgagaacataatgcttaggcaggagaatgataagctcagagctgagaacagtttgatcaaggaagccatgtcaaatccagtgtgtaacaactgcggtggccctgcaattcctggccaaatttcatttgaggagcaccagattagaattgagaatgcca

SEQ ID NO: 1945 - DNA, 219 bp, Glycine max
cagaagcaaaggatggatctcagtaagaggcttggcttggagaataagcaagtcaagttctggtttcagaatcgacgaacccaaatgaagacccaactggaacgccatgagaacataatgcttaggcagagaatgataagctcagagctgagaacagtttgatcaaggaagccatgtcaaatccagtgtgtaacaactgcggtggccctgcaattcctg

SEQ ID NO: 1946 - DNA, 260 bp, Glycine max
gttaatttacttgaacaaaactttggaaatgaacgcaaacttgagtccgaaagaaaggataggctggcaatggagcttggtttggaccctcgacaagttgctgtgtggtttcaaaacagaagagcccgttggaagaacaaaaagttggaagaagagtactccagccttaaaaaaaatcatgaagccacttgcttgagaaatgttgcctggagagtgaggtgttgaagctcaaagagcaactttctgaggcagagaaagag

SEQ ID NO: 1947 - DNA, 258 bp, Glycine max
aagaaacacaaaagatagaaagacgataaagagaaggagaaggggagaagagagaaaggttgtattgagagatatgtggaggggtaagattgagatcaaaaggattgagaactcaagcaacaggcaagttacctactcaaagaggaagaatgggatccttaagaaggcaaaggaaattagtgttctatgtgatgctcaagtttcccttatcatctttggtgtctctgggaagatgcatgagtacatcaacccctccac

SEQ ID NO: 1948 - DNA, 266 bp, Glycine max
tacggctgcgagagacgacagaagggggcatttaagaaactcaagagatagaaagaaaataaagagaaggagaagagaagaagagaaaggttgtgagagatatggggaggggtaagattgagatcaaaaggattgagaactcaagcaacaggcaagttacctactcaaagaggaagaatgggatcctcaagaaggcaaaggaaattagtgttctatgtgatgctcaagtttcccttatcatctttggtgtctccgggaagatgcat

SEQ ID NO: 1949 - DNA, 274 bp, Glycine max
gaaaattatgctggctaggcaaacaggcttgaccagaaaccaggtggcaaattggttcatcaatgcaagggtgcgtctctggaagccaatggttgaggaaatgtacaaagaggagtttggagattccgagatgaactgcaacctttcatctgagaacaacacggtcaaaggtaaaagagatgatgttcaagagtctgataacattaacaataataataataaatgggaagagtcacaggacaatttagtaactgttgacagtgtgcaagtccaa

SEQ ID NO: 1950 - DNA, 264 bp, Glycine max
cgagaatctgacggaggaaaatagaaggttgcagaaggaggttcaggagcttagagcactgaaactttccccacagttttacatgcaaatgacctcactcacgacgctcaccatgtgcccctcttgcgagcgtgtggctgttccgtactccgccgtcgatgctgccacgcgtcatcatcccatggcccagacccaggcccaggcccagattcggcacaggcccattggcccgtgggcttccgcctctcccattacgcaccggcc

SEQ ID NO: 1951 - DNA, 283 bp, Glycine max
cgagaatctgacggaggcaaatacaaggttgcagaatgaggttcaggagcttagagcactggaactttccccacagttttacatgcaaatgaccccatccacgacgctcaccatgtgcccctcttgcgagcgtgtggctgttccgtcctccgccgtcgatgctgccacgcgtcatcatcccatggcccagacccaggcccaggcccagattcggcacaggcccattggcccgtgggcttccgcctctcccattacgcaccggccgtttgatgtcttccaccac

SEQ ID NO: 1952 - DNA, 396 bp, Glycine max
ttcaggagcttagagcactgaaactttccccacagttttacatgcaaatgggcccacccgggacgctcaccatgtgcccctcttgcgagcgtgtggctgttccgtcctccgccgtcgatgctgccacgcgtcatcatcccatggcccaagcccatgcccatgcccagattcagcacaagcccattggcccgtgggctttcgactctcccattacgcaccggccgtttgatgtcttccaccactgatcttgaaggtgttttggtcattgggaaattattattatttactattctgggcctacttgtaccaacctgtaagtgtgtaaccccaaaaggggaagaaaattgggggaaacagaaagaatgaaggaaccgtcgaaacaacctgctttggaat

SEQ ID NO: 1953 - DNA, 146 bp, Glycine max
tctcactcttcttgcagcatctctctccattaccttcataactcaatctcccattattattagagatgacggttgaaaaggaagatttgggtttgagtctaagcttgagcttccctcagaaccccccaactcatcttcatctcaat

SEQ ID NO: 1954 - DNA, 246 bp, Glycine max
cactcttcttgcagcatctctctccattaccttcataactcaatctcccattattattagagatgacggttgaaaaggaagatttgggtttgagtctaagcttgagcttccctcagaaccccccaactcatcttcatctcaatctcgtttcctcttctccttccagccataaccctcagaaaccctcttggaactaactcttcacttcttcagctggatcatcattccttcgatgaatcgatgtgg

SEQ ID NO: 1955 - DNA, 268 bp, Glycine max
tagagaagtcccttaaataaatctgaatttccctgctttgcttcaccaccccccttgcttgcgtgggtagaaatgcaagaagcagggctgggaatgggaatgggaatgatgagcggagaagtatcgccgccggggaccaccaccgtcaagtgaaggcggagatagccaaccacccactctatgaacagcttctatctgcacacgtgtcatgcctccgcgtcgccacacctatcgatcagttgccgctcatcgacggacagttatcgca

SEQ ID NO: 1956 - DNA, 266 bp, Glycine max
gccaaatgtgagtccttcaatgcatcatcaggaaggacaggtggttcaataggtgaagatccagctctggaccagttcatggaggcctactgtgagatgctcattaagtatgagcaagagctcactaaacccttcaaagaagccatgcttttcttctcaagaattgagtgtcaactcaaagccctagcagtttcatcagattttggtcaaagtgaaacatcttcgcagaatgaggttgatgttcaggaaaacaacctagattctca

SEQ ID NO: 1957 - DNA, 260 bp, Glycine max
gccaaatgtgagtccttcaatgcatcatcaggaaggacaggtggttcaataggtgaagatccagctctggaccagttcatggaggcctactgtgagatgctcattaagtatgagcaagagctcactaaacccttcaaagaagccatgcttttcttctcaagaattgagtgtcaactcaaagccctagcagtttcatcagatttgggtcagagtgaaacatcttcgcagaatgaggttgatgttcatgaaaacaacctagt

SEQ ID NO: 1958 - DNA, 332 bp, Glycine max
tgacagggaactggagacagatatggattggcatcacggcacaaagccacttgttcctcggccagagaccttaagcttcttctacaactataactacaacagtccatatccaggagtggaagtgaaacaagcagcattgatggagacaggagaagggtcagttccagcattaatggacagcagaaacaaagagaagaagaagcgattaacaaataaccagatagagttattggagaggagttttcaggaggagataaagttggaccctgaaaggaagatgaagctttccagggagctaggccttcagcctcgccaaatcgctgtttggttcc

SEQ ID NO: 1959 - DNA, 250 bp, Glycine max
ctcaaactcaacttcaattgctaatttttataaagctagccggagatgatggttcaaaaggaagatttgggtttgagtttaagtctcaatttccctcatcacagtaccccaaatcctcaacatctgagtctcatgtcatcctctactcattcctcttccccttctggtttcaaccctcaaaaaccctcttggaacgaggctttcgcttcttcggatccagatcgaaactccgacacatgcagacgcgaaa

SEQ ID NO: 1960 - DNA, 261 bp, Glycine max
ctcgagccgattcggctcgagaggggtgtttccaccaaccggggaacctgcaggaggctcacacagcgaacaagttcagttcctctgaaaggaactttgaggtagagaacaagcttgaacccgaaaggaaagtccaacttgcaaaagagcttggcttgcagccaaggcaagttgctatatggttcttaaaccgaaggcaaggttcaagaccaagcagctagaaaaagactatggcgtgttgaaagctagttatgacagact

SEQ ID NO: 1961 - DNA, 421 bp, Glycine max
  unsure (1)..(421): unsure at all n locations
aacttcaatttattcatctctgacaccctcttaattctgcttccagttcctctgagtgatgggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaanaagactatggcgtgttgaaagctagttatgacagactcaanagtgactatgaa

SEQ ID NO: 1962 - DNA, 284 bp, Glycine max
gttctttcgcctttggttccggttcgtgaggtgaatttcctacggttttgcaagcagcacgcagaagggttgtgggctgtggtggatgtgtccatagatagcatcagagaaagttcaggagcacccacttttgtgaacggtaggaggcttccttctggttgcgtggtgcaagatatgcccaatggttattccaaggtgacatgggtggagcatgcagaatacgaagaaagccaagttcaccagctctataggcctttgttgagctcaggcatggggtttggtgc

SEQ ID NO: 1963 - DNA, 250 bp, Glycine max
tgtccatagatagcatccgagaaagttcgggagcacccacttttgtgaactgtaggaggcttccttctggttgcgtggtgcaagatatgcccaatggttactccaaggtgacatgggtggagcatgcagaatacgatgaaagtcaagttcaccagctctatagacctttgttgagctcaagcatggggtttggtgcccaacgttgggccgcatacccttcaacgccaatgcgagtgccttgccattctaa

SEQ ID NO: 1964 - DNA, 429 bp, Glycine max
cggacgcgtccgcccacgcgtccgaataaatggaactagaaatggtgcccttcagctgatgcatgctgagcttcaagttctttctcccttggttcctgttcgtgaggtcaattttctacgcttttgcaagcagcacgcagaggggttatgggcagtggtagatgtgtccatagataccatccgagaaacttctggagcacccacttttgtgaactgtaagaggcttccttctggttgcgtggtgcaagatatgccaaatggttactctaaggtgacatgggtggaacatgcagaatacgacgaaagccaaattcaccagctctttagaccctcgttgagctcaagcatggggtttggtgcacaacgttgggttaccactcttcaagccaatgcgagtgcctagccattctaatgtcctcagcagctccc

SEQ ID NO: 1965 - DNA, 445 bp, Glycine max
aagacacatacgaccacgcgattcgaattaatggaactagaaatggtgcccttgggctggtgcatgctgagcttcaagttctttctcccttggttcctgttcgtgaggtcaattttctacgcttttgcaagcagcacgcataggggttatgggcagtggtagatgtgtccatatataccatccgagaaacttctggagcacccacttttgcgaactgtacgaggcttccttctggttgcgtggtgcaagatatgccaaatggttactctaaggtgacatgggtggaacatgcagaatactacgaacgccaaattcaccagctctttagacccttgttgagctcatgcatggggtttggtgcacaacgtttggttaccactcttcaacgccaatgcgagtgcctacccattctaatgtactgagcatctccctctagagaacattc

SEQ ID NO: 1966 - DNA, 233 bp, Glycine max
gttggtttcaaatggtgaagcttcgagggaaactgctgttgttatcatgaaccatgttaaccttgttgagatcctcatggacgtgaatcaatggtccacggtgttctctggcattgtctcaagagcaatgactttggaagtgctatcaacaggggtggcggggaattacaacggtgcattgcaagtgatgacagcagaagtgcaagtaccttcacctctggtgccaactcgag

SEQ ID NO: 1967 - DNA, 430 bp, Glycine max
ctaaacctgctggtttcaagtttgaagcttcgagggaaacggctgttgttatcatgaagcatgttaaccttgttgagatcctcatggacgtgaaccaatggtccacagtgttcgctggcatagtctcaagagcaatgactttggaagtgttatcaacaggggtggcagggaattacaacggtgcattgcaagtgatgacagcagaagtgcaagtaccttcacctctggtgccaactcgagagagctattttgtgaggtattgtaagcagcacggtgacgggacttgggcagtagtggacgtgtcattggataatttgcgtcctagtccttctgccagatgtagaagaaggccctcaggttgcttaattcaagaaatgcccaatggctactcaaaggtcatatgggttgagcatgtagaagtggatgacac

SEQ ID NO: 1968 - DNA, 274 bp, Glycine max
  unsure (1)..(274): unsure at all n locations
anacaaataagacaaganagctgaaaacaccggcgcacttaaagccttggaggatttttataatgagcacaaataccccacggaggaaatgaaattagtacttgctgaggagttaggattgacagacaagcaaatatctggatggttttgccacagaaggttaaaagataaaagattgatganagatgaagccgttgctaatgggagacaagatcgtncaantggtgtcatccaagatcgtggcgtggactgggcaanattcatgcggaagcgt

SEQ ID NO: 1969 - DNA, 442 bp, Glycine max
cccactcgtccgcccacgcgtccggtgaattgcaatcagaagaaaataaagtctccaatgagaaaaataagaaaagaaagctgaaaacaccggcgcagcttaaagccttggaggatttttataatgagcacaaataccccacggaggaaatgaaattagtacttgctgaggagttaggattgacagaaaagcaaatatctggatggttttgccacagaaggttaaaagataaaagattgatgaaagatgaagccgttgctaatgggagacaagatcgttcaagtggtgtcatccaagatcgtggcagtggacttgggcaagattcatgcggaagcagtaagcatgctgatcacaggtatctggatccgaaggaggttgagagccatggcctctacaatcacgaattgtcagttgcagatatgacccacagacgtaggaacca

SEQ ID NO: 1970 - DNA, 444 bp, Glycine max
acgcatccgtaaggctgcgagaagacgacagaagggggttgttcgctttgcaattttttcttctagaacaccgcctcagccacactacaaagacgcgacgacgcacagaaggcgaagaagctaaacgacgacgcagcgttatggaagacgaaatgtacggcgtgtcgtccacgacggagtactcggacggggcgctgatgacgccggagaacatattcccggcggagtaccacagcttcctaatgtcctccgccgcccggattccgatgttcggatccgacgagcttctctccgccgtcaccgccggcaacgaaaccgaaccctaccctggcgccaccatcgcaccggaaattcagcgccaaaacgacgcctcctctctcatcaaagccaaaatcgcctctcaccctcactaccctcgccttctccaagcctacatcgattgcc

SEQ ID NO: 1971 - DNA, 290 bp, Glycine max
  unsure (1)..(290): unsure at all n locations
ggaaaaataaagggatcaaatttaagttccttgatctaataagatccttgcttttaattgtactactcatgaagagacttggcagttcggatacactgggtgctctcatgacgatttgtccaccaacagacgaacanagtccgaggaacaaccacgtgtatgggaaggagttccagtccatgctggaaggactcgacgaagaagggtgcgtggaagaagcanggcaccactctgagaagaaacgacgactaaacgtagatcaggtgaaggccttggagaagaacttcgaa

SEQ ID NO: 1972 - DNA, 278 bp, Glycine max
ggcagttctgattctctgggtgctctcatgacgatttgtccaccaacagacgaacacagtccgaggaacaaccacgcgtatgggagggagtttcagtccatgctggaaggactcgacgaagaagggtgcgtggaagaacagggcaccactctgagaagaaacgacgactaagcgtggatcaggtgaaggctttggagaagaacttcgaagtagagaacaaactcgaacctgaccgaaagttgaagctggcacaagaacttggcttgcaaccaagacaa

SEQ ID NO: 1973 - DNA, 264 bp, Glycine max
ctcatgacgatttgtccaccaacagacgaacatagtccgaggaacaaccacgcgtatgggagggagtttcagtccatgctggaaggactcgacgaagaagggtgcgtggaagaaccagggcaccactctgagaagaaacgagactaagcgtggatcaggtgaaggctttggagaagaacttcgaagtagagaacaaactcgaacctgaccgaaagttgaagctggcacaagaacttggcttgcaaccaagcaagttgcggtttg

SEQ ID NO: 1974 - DNA, 294 bp, Glycine max
agagcagggcaccactctgagaagaaacgacgactaaacgtagatcaggtgaaggccttggagaagaatgtcgaagtagagaacaaactggaacctgaccgaaaggtgaagctcgcgcaagaactcggcttgcaaccaagacaagttgcggtttggttccaaaaccgccgtgccagatggaaaacaaagcaattggaaagagattacggcgtcctcaaagccaattacggatcacttaaacttaactttgacacccgccaacaagacaacgaagccttactcaaacagataaag

SEQ ID NO: 1975 - DNA, 260 bp, Glycine max
gttcggatacactgggtgctctcatgacgatttgtccaccaacagacgaacatagtccgaggaacaaccacgtgtatgggaatgagttccagtccatgctggaaggactcgacgaagaagggtgcgtggaacaccagggtaccactctgagaagaaacgacgactaaacgtagatcaggtgaaggccttggagaagatcttcgaagtagagaataaactggaacctgaccgaaaggtgaagctcgcgcaagaactcggct

SEQ ID NO: 1976 - DNA, 228 bp, Glycine max
ctgggtgctctcatgacgatttgtccaccaacagacgaacacagtccgaggaacaaccacgtgtatgggaaggagttcgagtccatgctggaaggactcgacgaagaagggtgcgtggaagaagcagggcaccactctgagaagaaacgacgactaaacgtagatcaggtgaaggccttggagaagaacttcgaagtagaggacaaactggaacctgaccgaaaggtg

SEQ ID NO: 1977 - DNA, 262 bp, Glycine max
ccagtccatgctggaaggactcgacgaagaagggtgcgtggaagaagcagggcacactctgagaagaaacgacgactaaacgtagatcaggtgaaggccttagagaagaacttcgaagtagagaacaaactggaacctgaccgaaaggtgaagctcgcgcaagaactcggcttgcaaccaagacaagttgcggtttggttccaaaaccgccgtgccagatggaaaacaaagcaattggaaagagattacggcgtcctcaaag

SEQ ID NO: 1978 - DNA, 248 bp, Glycine max
gagtttcagtccatgctggaaggactcgacgaagaagggtgcgtggaagaaccagggcaccactctgagaagaaacgacgactaagcgtggatcaggtgaaggctttggagaagaacttcgaagtagagaacaaactcgaacctgaccgaaagttgaagctggcacaagaacttggcttgcaaccaagacaagttgcggtttggttccaaaaccgtcgtgccagatggaagacaaagcaattggaaag

SEQ ID NO: 1979 - DNA, 276 bp, Glycine max
tgtgcgtggaagaaccagggcaccactctgagaagaaacgacgactaagcgtggatcaggtgaaggctttggagaagaacttcgaagtagagaacaaactcgaacctgaccgaaagttgaagctggcacaagaacttggcttgcaaccaagacaagttgcggtttggttccaaaaccgtcgtgccagatggaagacaaagcaattggaaagagattacggcgtcctcaaagccaattatgaatcacttaaacttaactacgacaccctccaacaag

SEQ ID NO: 1980 - DNA, 253 bp, Glycine max
  unsure (1)..(253): unsure at all n locations
ataggacatagtatcagtccctgntggaaggactcgacgaagaagggtgcgtggaagaaccagggcaccactctgagaagaaacgacgactaagcgtggatcaggtgaaggctttggagaagaacttcgaagtagagaacaaactcgaacctgaccgaaagttgaagctggaacaagaacttggcttgcaaccaagacaagttgcggtttggttccaaaaccgtcgtgccagatggaagaccaagcaattgga

SEQ ID NO: 1981 - DNA, 279 bp, Glycine max
cggctcgagctctctcagcttttcatcttccgatcttaatatacattgactaaaagaaaaataaagggatcaaatttaagttccttgatctaataagatccttgcttttaattgtactactcatgaagagacttggcagttcggatacactgggtgctctcatgacgatttgtccaccaacagacgaacacagtccgaggaacaaccacgtgtatgggaaggagttccagtccatgatggaaggactcgacgaagaagggtgcgtggaagaagcagggc

SEQ ID NO: 1982 - DNA, 400 bp, Glycine max
gattatgtcttgatttgaaaacagacgaacacagtccgaggaacaaccacgcgtatgggagggagtttcagtccatgctggaaggactcgacgaagaacggtgcgtggaagaaccagggcaccactctgagaagaaacgacgactaagcgtggatcacgtgaaggctttggagaagaacttcgaagtagagaacaaactcgaacctgaccgaaagttgaagctggcacaagaacttggcttgcaaccaagacaagttgcggtttggttccaaaaccgtcgtgccagatggaagacaaagcaattggaaagagattacggcgtcctcaaagccaattatgaatcacttaaacttaactacgacaccctccaacaagaccacgaagccttactcaaagagat

SEQ ID NO: 1983 - DNA, 369 bp, Glycine max
gcaaggcaccactctgagaagaaacgacgactaaacgtagatcaggtgaaggccttggagaagaacttcgaagtagagaacaaactggaacctgaccgaaaggtgaagctcgcgcaagaactcggcttgcaaccaagacaagttgcggtttggttccaaaaccgccgtgccagatggaaaacaaagcaattggaaagagattacggcgtcctcaaagccaattacggatcacttaaacttaactttgacaccctccaacaagacaacgaagccttactcaaacagataaaggaattgaaatcgaggctggtgcaagaagagaacaacaacaacactgaaagcgatgtttcggtgaaggaagagatgata

SEQ ID NO: 1984 - DNA, 384 bp, Glycine max
  unsure (1)..(384): unsure at all n locations
aaggactcgacgaagaagggtgcgtggaagaaccagggcaccactctgagaagaaacgacgactaagcgtggatcaggtgaaggctttggagaagaacttcgaagtagagaacaaactcgaacctgaccgaaagttgaagctggcacaagaacttggcttgcaaccaagacaagttgcggtttggttccaaaaccgtcgtgccagatggaagacaaagcaattggaaagagattacggcgtcctcaaagccaattatgaatcacttaaacttaactacgacaccctccaacaagaccacgaagccttactcaaagagatanaggaattgaaatcgaagctggtgcaagaagagaacaacaacaacactgaaagcgatgtttccg

SEQ ID NO: 1985 - DNA, 249 bp, Glycine max
gaagaaaccaaacgcggccttgaagttgcgagttgcgagttgcagagagagcaatgagtgaggaatcgtttatatatggcttcgtggctcgggggacgatggtgttagccgagtacaccgagttcactggtaatttccctgcaattgcagctcactgtctcgagaaactttcctattacaatatcaagttcacctacaattgcgaccaccataccttcaattgtctcgttcaagatggctacgcttact

SEQ ID NO: 1986 - DNA, 277 bp, Glycine max
attcttttttttatttcttggtggaaaacagattgtgcatctaattccaaattcacccataaaaatacttcctttgctcaccagccatatattatgatggagggagatgagaatattcaagcatcatcaaagggaaaatatgttgaaagcttcaactgctcggaggcaccaaggaagaaaagcaagaagatagaaaacaagaggaggtttagtgatgaacagataagatcactagaatgcatatttgagtcagagtcaaagcttgagccaaggaaga

SEQ ID NO: 1987 - DNA, 262 bp, Glycine max
agtgcatctaattccagattcacgcataaaaatacttccttttgctcaccagccatatattatgatggagggagatgagaatattcaagcatcatcaaagggaaaatatgttgaaagcttcaactgctcggaggcaccaaggaagaaaagcaagaagatagaaaacaagaggaggtttagtgatgaacagataagatcactagaatgcatatttgagtcagagtcaaagcttgagccaaggaagaagatgcaactggctaga

SEQ ID NO: 1988 - DNA, 315 bp, Glycine max
tgtgtatccaattccaaattcacccgtaaaataccttcctttgtctcaccagccatatgtgtatgatggaaggagatgagaatattcaagcatcaacaaagggaaaaaatgtggaaagcttcaccagcttggaggcaccaaggaagaaaagcaagaagatagaaaacaagaggaggtttagtgatgaacagataagatcactagaatgcatatttgagtcagagtcaaagcttgagccaaggaagaagatgcaactggcaagagatcttggccttcagcctcgccaagttgccatatggttccaaaaagaagggc

SEQ ID NO: 1989 - DNA, 226 bp, Glycine max
gagacgacagaaggggggagatgagaatattcaagcatcatcaaagggaaaatatgttgaaagcttcaactgctcggaggcaccaaggaagaaaagcaagaagatagaaaacaagaggaggtttagtgatgaacagataagatcactagaatgctatttgagtcagagtcaaagcttgagccaaggaagaagatgcaactggctagagatcttggcctgcaacctc

SEQ ID NO: 1990 - DNA, 408 bp, Glycine max
  unsure (1)..(408): unsure at all n locations
attcttttttttatttcttggtggaaaacagattgtgcatctaattccaaattcacccataaaaatacttccttttgctcaccagccatatattatgatggagggagatgagaatattcaagcatcatcaaagggaaaatatgttgaaagcttcaactgctcggaggcaccaaggaagaaaagcaagaagatagaaaacaagaggaggtttagtgatgaacagataagatcactagaatgcatatttgagtcagagtcaaagcttgagccaaggaagaagatgcaactggctagagatcntggnctgcagcctcgccaagtggctatatggtttcaaaacagaagggcaagggtggaatcaaaacgaatagagcaagagtaccgaaaactcaaagatgaatatgacaa

SEQ ID NO: 1991 - DNA, 289 bp, Glycine max
gcttcaagcggcaacaacatgctctttctcggcaacactgaacttgcttttcgagggagatcgattatgagcatggaggaagcctcgaagagcgacctttcttcacctcaccggatgaactgtatgatgaagagtattatgagaagcagtcgccgagaagaagcaccgcctcagttccgaacaggtccatctgttggagaagagctttgaggaagagaacaaattggagcctgagaggaagacccagttggctaagaagctgggattgcagcccaggcaggtggctgtg

SEQ ID NO: 1992 - DNA, 244 bp, Glycine max
  unsure (1)..(244): unsure at all n locations
accaaacaattggagagagattatggtgtactcaaagccaattatgatgctcttaagcttaactttgacaccctcgatcaggacaacgaagccttacgaaagcaggttaaggaattgaaatcgaggctgctgcaagaagagaacacaggaggaagcggtgtttcggtgaaggaagagataataacgaggcctgcagactcagaagacaaaangatggaacaaagtaagagtgnnccatcttctg

SEQ ID NO: 1993 - DNA, 276 bp, Glycine max
ggtagccgtatggttccaaaaccgtcgagccagatggaaaaccaaacaaagacagagagattatggtgtactcaaagccaattatgatgctcttaagcttaactttgacaccctcgatcaggacaacgaagccttacgaaagcaggttaaggaattgaaatcgaggctgctgcaagaagagaacacaggaggaagcggtgtttcggtgaaggaagagataataacgaggcctgcagactcagaagacaaaacgatggaacaaagtaagagtgaccc

SEQ ID NO: 1994 - DNA, 362 bp, Glycine max
aaagccaattacggatcacttaaacttaactttgacaccctgcaacaagacaacgaagccttactcaaacagataaaggaattgaaatcgaggctggtgcaagaagagaacaacaacaacactgaaagcgatgtttcggtgaaggaagagatgatagccactctgcaggatagtaacccgctctgtgaatccgccattcctggatcggactcgaaggagttgagttacgagtgtttcaacaagagtgatgaggtgggagggggttctgtgttccctgtggatttcaaagatgggtcttctgatagcgactcaagtgcgatcttgaacgaggagaacaacatccacagccccaacaacaacgc

SEQ ID NO: 1995 - DNA, 239 bp, Glycine max
gagaagagctttgatgaggagaacaagctcgagcccgagaggaagatttggctagccaaggaactcggcttgcagcctaggcaggtggcgatttggtttcagaaccgccgcgcgcgctggaagaccaagcagatggaaaaggactatgattccctgcagactagttacaatgatctcaaggctaactatgacaaccttctcagggaaaaggataaactcaaagctgaggtggcaaggct

SEQ ID NO: 1996 - DNA, 219 bp, Glycine max
cgagtacttccaccagcctgagaagaagcgcaggctctccatggagcaagtgaactttcttgagaagagctttgatgaggagaacaagctcgagcccgagaggaagatttggctagccaaggaactcggcttgcagcctaggcaggtggcgatatggtttcagaaccgccgcgcgcgctggaagaccaagcagatggaaaaggactatgattccctgca

SEQ ID NO: 1997 - DNA, 237 bp, Glycine max
cgagtacttccaccagcctgagaagagaagaaggctctccgtggagcaagtgaagtttcttgagaagaactttgatgagcagaacaagctcgagcccgagaggaagatttggctagccaaggaactcggcttgcagcctaggcaggtggcgatttggtttcagaaccgccgcgcgcgctggaagaccaagcagatggaaaaggactatgattccctgcaggctagttacaatgatct

SEQ ID NO: 1998 - DNA, 246 bp, Glycine max
cggcttgcagcctaggcaggtggcgatttggtttcagaaccgccgcgcgcgctggaagaccaagcagatggaaaaggactatgattccctgcaggctagttacaatgatctcaaggctaactatgcaaccttctcagggaaaaggataaactcaaagctgaggtggcaaggctcactgagaaggtgcttggaagagagaaaaatgagagtcacttggaacaggctgaaaccaacggattgcaggag

SEQ ID NO: 1999 - DNA, 281 bp, Glycine max
catattttagcacgccaaaccggtctctcgagaggacaggtttcgaattggtttattaatgcaagggtgagactatggaagccaatggtggaggaaatgtacttggaggaagtgaaggaccctgaaaacaacatagcttcctcagaaggggctactgatcaagacaatgatataaacccaaataatgttgaataccctccacctccttcttcatcacgatcagaggatcagaagccatctctggttcgaattgactccgagtgtgcatcctccatcatcaa

SEQ ID NO: 2000 - DNA, 227 bp, Glycine max
gatcaatcacaatgcttggagaccccagagaggattgcctgagagatcggtttctgttctgcgtgcttggctctttgaacactttctccacccttatcccaaggactcggacaaacacatgcttgcaaaacaaacagggctcaccagaagccaggtttcaaattggttcataaatgctcgagttcggctttggaagccaatggtggcggacatgtacttggcggaga

SEQ ID NO: 2001 - DNA, 284 bp, Glycine max
  unsure (1)..(284): unsure at all n locations
cttctccaattcccctttctctgaatctagancgttgagcttcaanttcagctcatttatgtacgatatggcgtcacctaacaacgatgccttgtccatcttggatacatttggaactacagctcgtagagatagaatctttgattcagcttttctctcctttgtctctcggcttccacgtgattcagcggcnccctctctgccgttggccggctttcgccccctcttccgaggccgtttctccggctccatcactctgctgtctgcctgtttcaccatggaag

SEQ ID NO: 2002 - DNA, 287 bp, Glycine max
  unsure (1)..(287): unsure at all n locations
gaaaaggccngtngngaggtctganaanagcatntncacgcccatncctcagantggnctccattccgcagcctcagtgcaagncccaggtcctacacatatggcgtgtggagaagctgaagncggtgcccatagcacganagaaccatggcatctttttttctggggatnctacctagtgnntcacaatngcacngaagaggcctcncatctgcacctgtggataggccagcagtcatcgcgcgatgaccatggggctgcgctgtgctagtgtgcacctcanaacc

SEQ ID NO: 2003 - DNA, 234 bp, Glycine max
ccacggttaataagacgatgcttttcgaaacccctggttccagtaccctaaccgaaacccctagcgctgctgctgctgttcacgtccccaattctaaaagccagggattcttcccgagggaattgaacttttcgaattcattgaaacctgaatccggtgaaattctgagctttggggagagcaagaagagctcttacaatggggctttctttcccggtgttgttgcggttgagg

SEQ ID NO: 2004 - DNA, 250 bp, Glycine max
ctcctatttgctgatgagaatgttgacattgctgttattgaggctgggttagggggtgcacgagatgcaacaaatataatatccagctctgggcttgttgcatcagtcataaccactgtaggtgaagaacatttggcagctcttgggggttctttggaaacaattgcaatggcaaaggcaggaatcataaaacaagaccgcccattggtgttgggtggcccatttgtccctcatattgagcgcattattc

SEQ ID NO: 2005 - DNA, 251 bp, Glycine max
atccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctgaatgatcaaccaggggatagtagt

SEQ ID NO: 2006 - DNA, 250 bp, Glycine max
ttcaagaggcttctcagttgctgtcttgtttggctgactttgtgtactgcacggtctgtgcatgcatgcagactcagcacaagattgagatggacaagcgagacgggaaatttggaccccaaccagcaatggcagtgcctcctatgcagcagatgtcacgcattgatcaacaagttcctccttcggttgggtatgcaccacaaccagcttatggacagcctgctcaaggatatcctgctccgggttatcc

SEQ ID NO: 2007 - DNA, 248 bp, Glycine max
gagaagaaactagcaattactgtcttcagtttccctccagacaaaggaaacgttggaactgctgcctatctcaatgtcttcgcctccatatactcagttatgaaagaactaaaaaaagatggttataatgttgacggccttccagagatccagaagctttgattgaagatgtaattcatgacaaagaagctcaattcagcagcccaaatctgaatattgcttacaaaatgagtgtccgcgagtaccaa

SEQ ID NO: 2008 - DNA, 254 bp, Glycine max
ggtccccggtggtttctcggagcagcattgacgatggaatgctttccttcacttccctgccggctgcaaatataaaatcagttaacggtgcttgtgtcggtgccggtgattccgatcactcggacctggaagctgaaccaaagattctatgctctacgagctgtagttccaaatgtatccaagatggacaaggcatcgctgttgggggacgccatattgtacattaacgagttgaaatcgaagctcaacgtgct

SEQ ID NO: 2009 - DNA, 252 bp, Glycine max
cagatagatacacacactctctcttttccactccctctttcgccgccaaaacaaaccaaacccacacttcactctcactctcatccaattccaaatgctcgttgttggtgcactgaatgaccgagtaccggatgaacctgtggaccgacgacaactcctccgtcatggaggccttcatgagctcctccgacctctcctccctctggctccccacgccgcaatccgccgcctctactaccactcctggactgg

SEQ ID NO: 2010 - DNA, 249 bp, Glycine max
gtcgagctcgcctccgcggaggtcatttttcagaaccccgatctgatgaacaaggtgcgtgatttgttcaacttcaacaacaacaacaacaacaacaaccctgaaacgtgttcctgggcgttgaattgcgttgccaccaccgatcaaggcgagaacgacccttcctcgctctggctcaaccctgaaatcaaagactcctccaccgtctcgccgccgaattccacggttaataagacgatgcatttcgaa

SEQ ID NO: 2011 - DNA, 248 bp, Glycine max
cttcaaggttcaagtataagatcccaaaggggcatagatcagctaatagaatctcacgcatagtgtctgagacacttaggcttgggatggaggatgtgaggtggtttgtgatgggggatgatgacacggtttttgtggcagaaaatttggtgaaagtgttgcaaaaatatgaccacaatcagttttattacattgggagttcctcggagagtcacttgcaaaacatttatttttcttataatatggct

SEQ ID NO: 2012 - DNA, 269 bp, Glycine max
tcagcacaagattgagatggacaagcgagacgggaaatttggaccccaaccagcaatggcagtgcctcctatgcagcagatgtcacgcattgatcaacaagttcctccttcggttgggtatgcaccacaaccagctatggacagcctgctcaaggatatcctgctccgggttatcctcctactggttacccccctgctgcttatcctccaccaggatatcccccttctggctaccctaagtgattggtctacagcgcaccaattgatcg

SEQ ID NO: 2013 - DNA, 289 bp, Glycine max
  unsure (1)..(289): unsure at all n locations
agaaaccaaaaagcggagaataaaccaaacacaaacacaaaaacctcccaggaaaaacgacaactatgtccaantccgaacactccgattcggattgtcccacgttgccaaccgccaccaccccgacaacctcggagccgaagaaaagagggagaaaaccgattctcggacgcgagactccggtaaaccacgtggaggcagagagacaacgtagggagaagctcaatcatcgattctatgcgcttcgtgctgttgttccgaatgtttcgaggatggacaaggcttcgct

SEQ ID NO: 2014 - DNA, 270 bp, Glycine max
  unsure (1)..(270): unsure at all n locations
cccaaatgtatccaagatggacaaggcatcgttgttaggtgacgccatatcgtacataaatgagcngaaattgaagctcaacgggctggattcagagaaaggggaattggagaagcaattggattcagccaagaaggaacttgagctcgcgaccaaaaacnnnnnnnnnnnnnnnnnnnnnnnnnnnggactacctccatctaataacgaagaagcaaagaagacaacgaccaagctcgctgatttggagatagaggtgaagataattgg

SEQ ID NO: 2015 - DNA, 284 bp, Glycine max
  unsure (1)..(284): unsure at all n locations
ccttcgtcaacggcggaggacttcccggacaggccttcttcaactccgctccggtgtgggtcaccgggggcgaccgtctctctgcctcggcctgcgagagggcgaggcagggacacgtgttccggctgcaaaccctggtttgcataccgtccgcgaacggcgtcgttgagctggggtccaccgagntaattttccagacncccggatctgatgancaaggtgaaggttctgtcnantttcagcaacaanaacttngacatgggtnttcttggcccccnacaacc

SEQ ID NO: 2016 - DNA, 268 bp, Glycine max
  unsure (1)..(268): unsure at all n locations
ctcctccagcggaaaatgctgggctatacaaaggtcttaagcagttaagtgagcncatctcctcatatcagttccctgcaaanacaccggccgtggggcacaaattgtgagtcccaattatcagcacagctaaacaatgcagtcttgacaaggatgtgactctgccagatgagggtnatgagatcccatctanagagngcnaccttgtggttngacnggtgtattccaagatnntggagatcgngtctcgtntgtnaccttgtgggct

SEQ ID NO: 2017 - DNA, 248 bp, Glycine max
cttagatagttcaatttccacccctgctcgtcccaaaaggcgcagaaccaaaagcaggaagaataaggaagagattgagaaccagagaatgactcacattgctgtagagcgcaacagaaggaagcaaatgaacgagtatctctctgttcttcgctctctaatgcctgaatcttacgtccaaaggggtgatcaagcatctataattgggggtgctatcaactttgttaaggagctggagcagaggctgc

SEQ ID NO: 2018 - DNA, 264 bp, Glycine max
cttaaacactcgtcccaagaggcgcagagccaaaagcagaaagaacaaagaagaaattgagaaccaaagaatgactcacattgctgtggaacgcaatagaagaaagcagatgaatgagtatctttctgttcttcgctctcttatgccagactcttatatccaaaggggtgatcaagcttctataattggaggtgctattaactttgtcaaagagcttgacagaggatgcattttcttggtgctcagaaagaaggagaggggaaa

SEQ ID NO: 2019 - DNA, 258 bp, Glycine max
cctcgagcgaattcggctcgaggggaaaccataaattgggaacacgtcaccaaatccacctccaccgtccaagccatcggatcctcgccggaaaacatgttcgtgagcttcgaatcttcccgcagaaactcgaattcgataatggtttacgatttgcataccctaacacccgtcacggagatcagtcacaacgagatcttcggcgcgaacatcgattcggcgattccggcgacgaagttgcaatggattgagggatat

SEQ ID NO: 2020 - DNA, 278 bp, Glycine max
gagcaggaccaccgcaaaaaagttctccgcgaactcaactccctgatctccggctcctcctcctcctccgccgcctccgacgacgtcgacgaggaggtcaccgacaccgagtggttcttcctcggtctccatgacgcagtccttcgtcaacggcggaggacttcccggacaggccttcttcaactccgctccggtgtgggtcaccgggggcgaccgtctctctgcctcggcctgcgagagggcgaggcagggacacgtgttcgggctgcaaaccctgg

SEQ ID NO: 2021 - DNA, 279 bp, Glycine max
gttttcataattcctgaaacaggggaaggaaatggcctcacaacaacacatccagaagatgcagctccgccagaacttccgcaatctctggcactctgatcttttgagtacaattcaagctgacaccccttattgttgcttttctctgtggtgtgcaccgtgtgtatcatatctactccgcaaacgagctctttacgatgatatgtcaagatacacatgttgtgctggttacatgccctgcagtggtcggtgtggagaaagtaaatgtcctgaactctg

SEQ ID NO: 2022 - DNA, 272 bp, Glycine max
tggtgttccagacaacagaagaaatactcaagagtactcttggtctgcatccaattcaggttgctcgtcaagttgactctgaagagctagatggagggatggaggcaattgtattcgctggtcgatatgctatgacaggaaaatctcatgctctatataagagagtggaacagctctgcatcagggcaatcagatgggctgtattggctagataatcagatgaagagttgtcactaggagtcactgtctgtcagtttcactccagacaaagg

SEQ ID NO: 2023 - DNA, 265 bp, Glycine max
cggctcgagcaacgaccaagctcgctgatttggagatagaggtgaagataattggttgggatgcgatgataagaatccaatgcagcaagaagaaccaccctgcagcaaggttgatggcagcattgaaggacctggacttggaagtgcatcacgcaagcgtgtccgtggtgaatgatttaatgatccaacaagccacggtgaacatgggaaacaagttttacacgcaggagcagcttctgtcggcactctcgtccaaagttggcga

SEQ ID NO: 2024 - DNA, 217 bp, Glycine max
tacgggacgacagaagggggatgtgaggtggtttgtgatgggggatgatgacacggtttttgtggcagaaaatttggtgaaagtgttgcaaaaatatgaccacaatcagttttattacattgggagttcctcggagagtcacttgcaaaacatttatttttcttataatatggcttatgggggtggtggttttgccattagttatcccctggctgtg

SEQ ID NO: 2025 - DNA, 278 bp, Glycine max
ctgcgagaagacgacagaagggtgggccggtaccacatgcacctgtttatcatgccatgatattatgcataaggaacaaccttaagatttaggcagggagcatataatcataaagtcgtgtggctacctcatccatgaggagcagtccccattctctgtttcttatttcttcaatgatcttttcagattcttcagaccgcttaccaccaaaagcaaccatattatatgttgtcgcaacaactccagcattaccacggaatctctctttgctatcagac

SEQ ID NO: 2026 - DNA, 252 bp, Glycine max
cttgccaacaggaaagaatattcatgccctggaccctcaatctattcctacaactgcagcgatgcagagtgccaaaatagtggtagataggttgattgagaggcagaaagctgagaatgggggaaaatatcctgagacaattgcacttgtattgtggggaactgataatattaaaacatatggtgaatccctggctcaagtcttgtggatgattggtgtggaaccagtggctgatacctttggcagggtaaa

SEQ ID NO: 2027 - DNA, 262 bp, Glycine max
gagaactcagggtgaaagtggatgcgaagagtactgatcaaaagccaaacacaccaagatcaaaacactctgcaacagaacagcggagaaggagcaaaattaatgacagattccaaatgctaagagagcttattccacacagtgaccaaaagagggacaaagcatcttttttattggaggtcgttgagtatattcattttttacaagagaaggtgcacaagtatgaaggttcatttcaagggtggagtaacgagccagaaaa

SEQ ID NO: 2028 - DNA, 116 bp, Glycine max
ggaagttctacacttttttgtttggattgatcgagtgtactttttcttttcgagattggcttggtgtgcagtggaaagagggtggaaaagagtggtaagggggagggcggcgcccc

SEQ ID NO: 2029 - DNA, 125 bp, Glycine max
gcagagggaagttctacacttttttgtttggattgatcgagtgtactttttcttttcgagattggcttggtgtgcagtggaaagagggtggaaaagagtggtaagggggagggcggcgccccttg

SEQ ID NO: 2030 - DNA, 116 bp, Glycine max
  unsure (1)..(116): unsure at all n locations
ttctacacttttntntttggnttgatcgagtgtactttttcttttcgagattggcttggtgtgcagtggaaagagggtggaaaagagtggtaagggggagggcggcgccccttgct

SEQ ID NO: 2031 - DNA, 262 bp, Glycine max
ggcaactgggatcaataatagctgaaacttctactgtacagggttcggcttgcccaactgtccaagcttgagatctattttagaatatgcttaacacaacacatgcaattcgaacgttgttttctcgaatttcataagagaagaaagctgctagcagagggaagttctacacttttttgtttggattgatcgagtgtactttttctttcgagattggcttggtgtgcagtggaaagagggtggaaaagagtggtaaggggga

SEQ ID NO: 2032 - DNA, 171 bp, Glycine max
caggacccatcagtactgcatgcgagaagacgacagaaggggctgctagcagagggaagttctacacttttttgtttggattgatcgagtgtactttttcttttcgagattggcttggtgtgcagtggaaaaagggtggaaaagagtggtaagggggaaggcggcgccctc

SEQ ID NO: 2033 - DNA, 167 bp, Glycine max
acggctgcgagaagacgacagaaggggaagaaagctgctagcacagggaagttctacacttttttgtttggattgatcgagtgtactttttcttttcgagattggcttggtgtgcagtggaaagagggtggaaaagagtggtaagggggagggcggcgccccttgtc

SEQ ID NO: 2034 - DNA, 159 bp, Glycine max
tacggctgcgagaagacgacagaagggtacggctgcgagaagacgacagaaggggaagaaagctgctagcagagggaagttctacacttttttgtttggattgatcgagtgtactttttcttttcgagattggcttggtgtgcagtggaaagagggtgc

SEQ ID NO: 2035 - DNA, 209 bp, Glycine max
  unsure (1)..(209): unsure at all n locations
cccacgcgtccgtacggctgcgagacgacagaaggggaagaaagctgctagcagagggaagttctacacttttttgtttggattgatcgagtgtactttttcttttcgagattggcttggtgtgcagtggaaagagggtggaaaagagtggtaagggggatggcggcgccccttacaaccacntcatctgcctccatctgacacaaaaa

SEQ ID NO: 2036 - DNA, 197 bp, Glycine max
cacgcgtcagtacggctgcgagagacgacagaatgggaagaaagctgctagcagaagggaagttctacacttttttgtttggattgatcgagtgtaccttttcttttcgagattggcttggtgtgcagtggaaagacggtggaaaagagtggtaaaggggagggcggcgccccaaaaaacaacactcaacttccatc

SEQ ID NO: 2037 - DNA, 336 bp, Glycine max
  unsure (1)..(336): unsure at all n locations
aggatgtgacactcccaaatgagggtgaggagatccctcttaangggcgtgaccttgtggttggaaaggtgtattccaagatcatggagantgagtctcgtctgttaccttgtgggcttcatgtcattggtgagcctccctcagccttggaagctgttgctacactggtcaacattgctgctcttgatcgtcctgaagatggtattcttctcttccatcaatatagctgacactgtaggaagagatatagaagatgtgtatagaggaagtaacaaaggaatattgaaggatgtggagctcttaggcaaataaccgaggcatcacgtggagcatcac

SEQ ID NO: 2038 - DNA, 260 bp, Glycine max
gaaatatcaaaactttgaaacaaaaacctctcatgctaagaggtctcctgctcatgctcaagatcacatcatggctgagagaaagcgaagagagaaactcagccagagcttcattgctcttgcagcccttgttcctggcctaaagaagatggacaaggcttctgtgttaggggacgctatcgaatatgtgaaagagcttaaagagcggttgacagttcttgaagagcagagcaagaaaacaagggcagaatcgatagtgg

SEQ ID NO: 2039 - DNA, 220 bp, Glycine max
gaaatatcaaaactttgaaacaaaaacctctcatgctaagaggtctcctgctcatgctcaagatcacatcatggctgagagaaagcgaagagagaaactcagccagagcttcattgctcttgcagcccttgttcctggcctaaagaagatggacaaggcttctgtgttaggggacgctatcgaatatgtgaaagagcttaaagagcggttgacatttctg

SEQ ID NO: 2040 - DNA, 253 bp, Glycine max
ctcaattgaatcaaatgatggctgggaattttaatgctcaagcaagggttccttgtctagatctcggtaatgaagactcatcatcaattcatgcagatgagcggaagcccaaaaaaagaggtaggaaacctgccaatgggagagaggagccgctgaaccatgttgaagctgagagacaaagacgtgagaagcttaatcagaggttttatgccttgagagctgttgtccctaatatatctaaaatggacaggca

SEQ ID NO: 2041 - DNA, 274 bp, Glycine max
accttatctctctcctcactccctcccctcacatagaaaaacaagcacgcacgcacacgcatacacacacacactctctcttttccactccctcttttggctgccagaacaaacaaaacccacacttcactcccatccaattccaaacccacgttgttgttggtgcatggaatgaccgagtaccggatgaacctgtggaccgacgacaactcctccgtcatggaggccttcatgagctcctccgacctctcctccctctggcttgccacgccgc

SEQ ID NO: 2042 - DNA, 267 bp, Glycine max
cagaacaaacaaaacccacacttcactcccatccaattccaaacccacgttgttgttggtgcatggaatgaccgagtaccggatgaacctgtggaccgacgacaactcctccgtcatggaggccttcatgagctcctccgacctctcctccctctggcttgccacgccgcagtccgccacctccaccacaactccaggctcggcaaaagcccctcctcatcctccccctcctccgccgccgccgggcagtcccagtccctcctcaac

SEQ ID NO: 2043 - DNA, 269 bp, Glycine max
attctacggcatcgagtccctcctcgtcaattccctttccaacccttctcaattggaaccttttaatctccaaaaatcgcttcttttacccttgaacggacgcgattccccctccgccctcgccgccaccgcttccggcgcctccacgtcgcgcacggcagcaagatcacctccttcgactggtccctccgccgcaaatccaccgtcctgactcaatttaccgccgtggattccctcctcgccctctcgccggccctcgccgccgccgg

SEQ ID NO: 2044 - DNA, 269 bp, Glycine max
  unsure (1)..(269): unsure at all n locations
gcgagtcagtactgagtagggtttcaaatttccaatcggaatcggaaaaaatgnnnnnnnnnnnnnnnnatcacggccatggacacggacacggcgatttcaggaacaaggtctggagtatgagcggtggcccttactgccgtcccaagcactggaagcgcaacaccgccattgccatggtcggcgtcnttctcatctgcatccccatcgctatgaaatccgctgaactcgagcaacggccacatcaccctgttcgccccatcccttct

SEQ ID NO: 2045 - DNA, 285 bp, Glycine max
  unsure (1)..(285): unsure at all n locations
cgagtnagtactgagtagggtttcaaatttccaatcggnatcggaaaaaatgggcggcggcggcggngatcacggccatngacanggacacggcgatttcaggaanaaggtctggagtatgngcggtggccctnactgccgtcccaagcactgnaagcgcaacaccnnnattnccatggtcggcgtcgntctcanctgcatccccancgctatgaaatccgcncaantcnagcaacggccacatcancctgtncgngccatcccttctcaactctggtgcaagaa

SEQ ID NO: 2046 - DNA, 256 bp, Glycine max
  unsure (1)..(256): unsure at all n locations
atcccaaagagagtgagcgagtcagtactgagtagggtttcaaatttccaatcggaatcggaaaaaatgnnnnnnnnnnnnnnnnatcacggccatggacacggacacggcgatttcaggaacaaggtctggagtatgagcggtggcccttactgccgtcccaagcactggaagcgcaacaccgccattgccatggtcggcgtcgttctcatctgcatccccatcgctatgaaatccgctgaactcgagcaacggc

SEQ ID NO: 2047 - DNA, 240 bp, Glycine max
atcccagagagagtgagcgagtcagtactgagtagggtttcaaatttccaatcggaatcggaaaaaatgggcggcggcggcggcgatcacggccatggacacggacacggcgatttcaggaacaaggtctggagtatgagcggtggcccttactgccgtcccaagcactggaagcgcaacaccgccattgccatggtcggcgtcgttctcatctgcatccccatcgctatgaaatccgct

SEQ ID NO: 2048 - DNA, 270 bp, Glycine max
  unsure (1)..(270): unsure at all n locations
tgcgagtcagtactgagtagggtttcaaatttccaatcggaatcggaaaaaatgggcggcggcggcggcgatcacggccatggacacggacacggcgatttcaggaacaaggtctggagtatgagcgttgngccttactgccgtcccaagcactggaagcgcaacaccgccattgccatggtcggcgtcgttctcatctgcatccccatcgctatgaaatccgctgaactcgagcaacggccacatcaccctgttcgccccatcccttct

SEQ ID NO: 2049 - DNA, 252 bp, Glycine max
gcgcgtctatcccaaagagagtgagcgagtcagtactgagtagggtttcaaatttccaatcggaatcggaaaaaatgggcggcggcggcggcgatcacggccatggacacgacacggcgatttcaggaacaaggtctggagtatgagcggtggcccttactgccgtcccaagcactggaagcgcaataccgccattgccatggtcggcgtcgttctcatctgcatccccatcgctatgaaatccgctgaact

SEQ ID NO: 2050 - DNA, 256 bp, Glycine max
gccaaagagagtgagtgagtagggtttcaaattccaatcggaagaaatcggaatcggaaaaaatgggaggtggcggcggcgatcacggccatggacacggacacggcgatttcaggaacaaggtctggagtatgagcggtggcccttactgtcgcccaaagcactggaagcgcaacaccgccattgccatgttcggcgttgtcctcatctgcatcccatcgctatgaaatccgctgaactcgagcaacgaccacat

SEQ ID NO: 2051 - DNA, 262 bp, Glycine max
aagagagtgagtgagtagggtttcaaattccaatcggaagaaatcggaatcggaagacatggtctgtggcggcggcgatcacggccatggacacggacacggtgatttcaggaacaaggtctggagtatgagcggtggcccttactgtcgcccaaagcactggtagcgcgacaccgccattgtcatgttcggcgttgtcctcatctgcatccccatcgctatgaaatccgctgaactcgaggaacgaccacatcaccctgtt

SEQ ID NO: 2052 - DNA, 236 bp, Glycine max
  unsure (1)..(236): unsure at all n locations
gatgccaaagagagtgagtgagtagggtttcaaattccaattcggaagaaatcggaatcggaaaaaatgggaggtggcggcggcgatcacggccatggacacggacacggtgatttcaggaacaaggtctggagtatgagcggtggcccttactgtcgcccaaagcactggaagcgcaacaccgccattgccatgttcggcgttgtcctcatctgnatccccatcgctatgaatcc

SEQ ID NO: 2053 - DNA, 282 bp, Glycine max
ggtttttgtgactgtgctccacaaccgagtcgccatggcgtcgcaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttg

SEQ ID NO: 2054 - DNA, 284 bp, Glycine max
caccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggttttcctctgctttggaaattcagtcgcctcaactcgctttctattgcaagatgaatttaacattcaaactacgcaatgtgata

SEQ ID NO: 2055 - DNA, 248 bp, Glycine max
atttagggtttttgtgactgtgctccacaaccgagtcgccatggcgtcgcaggagagtatcgaaaagatgcaggcacggcagaattaccggaatttatggcacaccgatctcatgagatccattcaggccgatattccttattgttgcctcgcgttgtggtgtgcaccatgtgtgtcttaccttcttcgcaaacgagctctatatgatgatatgtcaaggtacacatgttgtgctggctacatgcctt

SEQ ID NO: 2056 - DNA, 285 bp, Glycine max
atggcgtcgcaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggttttcctctgctttggaaattca

SEQ ID NO: 2057 - DNA, 261 bp, Glycine max
atcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggttttcctctgctttgga

SEQ ID NO: 2058 - DNA, 259 bp, Glycine max
atcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggttttcctctgctttg

SEQ ID NO: 2059 - DNA, 243 bp, Glycine max
ctcagcaaaacgaccacgatttcctcatatctgttatctgttatatatacctatatcgtatccgcatttccgaaaggatatatctgatctagtagggttttgtgactgctcaacaacccaatcgccatggcgtcgcaggagagtatcgaaaagatgctgtcacggcagaattaccggaatttatggcacaccgatctcttgagatccattcaggccgatacaccttattgttgcctcgcgttg

SEQ ID NO: 2060 - DNA, 243 bp, Glycine max
aaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttggattgaggttt

SEQ ID NO: 2061 - DNA, 267 bp, Glycine max
ccgagtcgccatggcgtcgcaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcac

SEQ ID NO: 2062 - DNA, 244 bp, Glycine max
ggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggttttcctctgctttggaaa

SEQ ID NO: 2063 - DNA, 286 bp, Glycine max
  unsure (1)..(286): unsure at all n locations
ccgatctcatgagatccattcaggccgatactccttattgttgcctcgcgttgtgntgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggtttcctctgctttggaaattcagtcgcctcaactcgcttctantgcnagatgaatttaacattcaaactacgcatgtgntattgcatt

SEQ ID NO: 2064 - DNA, 275 bp, Glycine max
cttatttagggtttttgtgactgtgctccacaaccgagtcgccactggcgtcgcaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagt

SEQ ID NO: 2065 - DNA, 265 bp, Glycine max
ttatttagggtttttgtgactgtgctccacaaccgagtcgccatggcgtcgcaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtg

SEQ ID NO: 2066 - DNA, 250 bp, Glycine max
ctcgagccgcttatttagggtttttgtgactgtgctccacaaccgagtcgccatggcgtcacaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggc

SEQ ID NO: 2067 - DNA, 255 bp, Glycine max
caacgatgcaggcacggcagacttaccggcctttctggcacaccgatctcctgagctccattcaggccgatactccttattgttgcctcgcgttgtggtgtgcaccctgtgtgtcttaccttcttcgcaaacgcgctctctatgctgctctgtcacggtccacatgttgtgctggctacatgccttgcagtggtcggtgtggcgaccgtccatgtcctgacttttgcctttgcactgaggttttcctctgctttg

SEQ ID NO: 2068 - DNA, 266 bp, Glycine max
tatcgagccgaatcggctcgagcttatttagggtttttgtgactgacctccacaaccgagtagccatggcgtcgcaggagaacatcgaaaagatgcaggcacggcagaattaccggaatttatggcacaccgatctcatgagatccattcaggccgatactccttattgttgcctcgcgttgtggtgtgcaccatgtgtgtcataccttcttcgcaaacgagctctctatgatgatatgtcaaggtacacatgttgtgctggctac

SEQ ID NO: 2069 - DNA, 395 bp, Glycine max
agcccacgcgtccgcccacgcgtccgtacggtttctgtgactgtgctccacaaccgagtcgccatggcgtcgcaggagagtatccaatagatgcaggcacggcagaattaccggaatttatggcacaccgatctcatgagatccattcaagccgatactccctattgttgcctcgcgttgtggtgtgcaccatgtgtgtcttaccttcttcgcaaacgagctcactatgatgatatgtcaacgtgcacatgttgtgctggctacatgccttgcagtggcaggtgtggagaacgtaaatgtcctgaattttgcctttgcactgacgttttcctctgctttggaaattcagtcgcctcaactcgctttctagtgcaagatcaatttaacattcaaac

SEQ ID NO: 2070 - DNA, 340 bp, Glycine max
attaattagggtttttgtgactgtgctccacaaccgagtcgccatggcgtcgcaggagagtatcgaaaagatgcaggcacggcagaattaccggaatttatggcacaccgatctcatgagatccattcaggccgatactccttattgttgcctcgcgttgtggtgtgcaccatgtgtgtcttaccttcttcgcaaacgagctctctatgatgatatgtcaaggtacacatgttgtgctggctacatgccttgcagtggtaggtgtggagaaagtaaatgtcctgaattttgcctttgcactgaggttttcctctgctttggaaattcagtcgcctcaact

SEQ ID NO: 2071 - DNA, 412 bp, Glycine max
gacccacgcatcagttccttgccttctacaaattctaatgcaattcaagaaccagttgctagagacattcatgggacctcagctaagttggaagagccgaaggaatccgagtgcaaagttcagactgatctggagctagattctgcaaagggttccgaaattgaacttgcaaattcggggaaacctatagatttattggaagaggaagatgcatgcccaatctgtttagaagaatatgatgcagagaatccaaaactcgcaacaaattgtgaccatcattttcaccttgcatgcattctggaatggatggaaagaagtgaaacttgccctgtgtgcgatcaggatttggttttcgaccctcccattgaataatacatcaacataggagttcaaatatactgtgtagtgtttg

SEQ ID NO: 2072 - DNA, 428 bp, Glycine max
tgataatgtaattactagcttgcctcctcctgatgaagggcctaatttgagcgatcagtcgtcttgaggatcaattggcacttcttggaaaggtgttgagtgctggtgatgatcaagttggattagagcaactagatgaagatgcagatgaaattgcccttcagagtgcccgtcgctctcaaggatccatgagtgcaatgtcaggtgcaaaagggatggtttatatggagtacagtactgtgcgtaaaggccaacaaggacagatcaagagcaagccgaaagatccagcgaagagacatttcttgtttaaaagaagatatggggcaacctaaatgtgccgtctttgtaatggtaccatacgaaaagttatcaagtatgcaggattgatggcttacttgacataacgcttggtgcctttttcttaaaaa

SEQ ID NO: 2073 - DNA, 351 bp, Glycine max
attagattcagattgtggccgtggcagccagcagcaatatctctaaactcgaaaaatggatcagcgaaagctacgagactcgtccaattcgaaacccgcttcagatgcagcaccccaacacgtcactctcacctctaaccgcttccgcaactctcaagctgctgtgagggagagagagaaagagaagggtgaaggggaaaacgaggatccaagtgcggcacgaaaggttctaaaggcagaccgcgagaagctcagaagggatcgactcaacgaacacttccaagagttgggaaacgcgttagatcctgatagaccaaagaatgacaaggcaactatcctcactgagaacgt

SEQ ID NO: 2074 - DNA, 265 bp, Glycine max
gcttatactaactaactcttcttgagaaactctttctcacacgccaagagtaacatgggatttccagtggggtacacagagttgatgctgccgaaggtgtttctgcaggtgctatccgtattgggcttgataagaaaactcatcaccgtcctcttgtgctacatgggcttccacgatttcttcgaatccgacattgcgtggccggagagggcgccggaattccagtcggtgtgggcggtgctcataagggaaatcctaccggtgg

SEQ ID NO: 2075 - DNA, 429 bp, Glycine max
tgcttatactaactaactcttcttgagatactctttctcacacgccaagagtaacatgggatttccagtggggtacacagagttgatgctgccgaaggtgtttctgcaggtgctatccgtattgggcttgataagaaaactcatcaccgtcctcttgtgctacatgggcttccacgatttcttcgaatccgacattgcgtggccggagagggcgccggaattccagtcggtgtgggcggtgctcataagggaaatcctaccggtggtgaagttctcggagatggagatggagatggcggaggcgccggagagctgcgcggtgtgtctgtacgagttcgagggagaggacgagatcagacggctgacgaactgccgtcacatattccacagagggtgtctggaccgttggatgggatacgatcaaagaac

SEQ ID NO: 2076 - DNA, 191 bp, Glycine max
ccaatctcaatcccagtgagtgctttctttctgtaactaaccccaatcatcaactcagtcagcgaatgaatctgtggacggacgagaactcctcggtgatggaggccttcatgccatcctccgatctctcctccatctggccccctcccgctcctccgcagccgcaatccacggcggtcttcaatcaggac

SEQ ID NO: 2077 - DNA, 255 bp, Glycine max
ccctgtgagtgctttctttctgcaactaacttgttccctcgtgaaccctaatcatcaactcaagcagtgaatgaatctgtggacggacgagaactcctcggtgatggaggccttcatgtcgtcctccgatctctcctcaatctggccctcgccggctccgccgcaatccacggcggtcttcaatcaggacaccctccagcatcgcctgcaggccttgatcgaaggcgcccgagagacctggacctacgccatctt

SEQ ID NO: 2078 - DNA, 269 bp, Glycine max
gttctctctctcccaaactcaatccctgtgagtgctttctttctgtaactaacttgttccctcgttaaccctaatcatcaactcaagcagtgaatgaatctgtggacggacgagaactcctcggtgatggaggccttcatgtcgtcctccgatctctcctcaatctggccctcgccggcgccgcgcaatccacggcggtcttcaatcaggacaccctccagcatcgcctgcaggccttgatcgaaggcgcccgagagacctggacctac

SEQ ID NO: 2079 - DNA, 227 bp, Glycine max
ctcaatcccagtgagtgctttctttctgtaactaaccccaatcatcaactcagtcagcgaatgaatctgtggacggacgagaactcctcggtgatggaggccttcatgccatcctccgatctctcctccatctggccccctcccgctcctccgcagccgcaatccacggcggtcttcaatcaggacaccctccagcaccgcctccaggccttaatcgagggcgcccg

SEQ ID NO: 2080 - DNA, 199 bp, Glycine max
caatccctgtgagtgctttctttctgtaactaacttgttccctcgttaaccctaatcatcaactcaagcagtgaatgaatctgtggacggacgagaactcctcggtgatggaggccttcatgtcgtcctccgatctctcctcaatctggccctcgccggcgccgccgcaatccacggcggtcttcaatcaggacaccct

SEQ ID NO: 2081 - DNA, 273 bp, Glycine max
  unsure (1)..(273): unsure at all n locations
aaactcaatccctgtgagtgctttctttctgtaactaacttgttccctcgttaaccctaatcatcaactcaagcagtgaatgaatctgtggacggacgatagntcctcggtgatggaggccttcatgtcgtcctccgatctctcctcaatctggccctcgccggcnccgccgcaatccacggcggtcttcaatcaggacaccctccagcatcgcctgcaggccttgatcgaaggcgcccgagagactggacctacgccatcttctggcagtct

SEQ ID NO: 2082 - DNA, 267 bp, Glycine max
  unsure (1)..(267): unsure at all n locations
ctcaatccntgtgagtgcttnctttctgtaactaacttgttccctcgttaaccctaatgatcaactcaagcagtgaatgaatcngtgnacggacnagaactcctcggtgatggaggccttcatgtcgtcctccgatctctcctcaatctggccctcgccggcncccgccgcaatccacggcggtcttcaatncaggacaccctccagcatctnctggcaggccttggatcgaaggncgncctagagactggacctacgccatcttct

SEQ ID NO: 2083 - DNA, 267 bp, Glycine max
  unsure (1)..(267): unsure at all n locations
cgcaaatgcaccttctcttgttctctctctcccaaactcaatccctgtgagtgctttctttctgtaactaacttgttccctcgttaaccctaatcatcaactcaagcagtgaatgaatctgtggacggacgagaactcctcggtgatggaggccttcatgtcgtcctccgatctctcctcaatctggccctcgccggcnccgccgcaatccacggcggtcttcantcaggacaccctccagcatcgcctgcaggccttgatcgaagg

SEQ ID NO: 2084 - DNA, 182 bp, Glycine max
ctaacttgttccctcgttaaccctaatcatcaactcaagcagtgaatgaatctgtggacggacgagaactcctcggtgatggaggccttcatgtcgtcctccgatctctcctcaatctggccctcgccggctccgccgcaatccacggcggtcttcaatcaggacaccctccagcatcgcct

SEQ ID NO: 2085 - DNA, 280 bp, Glycine max
cttttacacattcagttcatttccttattttctcaacaaaacaaccgagagttcgtcatatctgtatctgtatatatacctatacctatacctatatcgtatccgcatttccgaaaggatatatcttatttagggtttttgtgactgtgctccacaaccgagtcgccatggcgtcgcaggagagtatcgaaaagatgcaggcacggcagaattaccggaatttatggcacaccgatctcatgagatccattcaggccgatactccttattgttgcctcgc

SEQ ID NO: 2086 - DNA, 286 bp, Glycine max
  unsure (1)..(286): unsure at all n locations
gcagattgcaaagcgcgaacaagaagcttgcggagaacatagaggccaaggaagaagcgtgcgtcgagaccgaagcggcgaacagcattctgagagcacagacaatggaactgggccgatcgattgcgcttcttgaactccatccttgagatcgctgaagaggtcgaagggttatccgttgagattcccgagattccagatcctnctcctncaagccctggcagattcctncatccgatacaaccgattatggccaccgcaaacatgtttctgcgttgatcatcct

SEQ ID NO: 2087 - DNA, 280 bp, Glycine max
ttccataaataggctgcagtcactaataagtgttacatctcaggctgtgtctaccacctcaactgccattattggccttagggactctgatcttgtccctcagcttgttgatctcatacatggattcatgtacatgtggagatcaatgaccactaccatgaaattcaaagcaatatagtgcagcaagtccgtggtcttgtgaacagatcatcaagaggtgactccacttctgaactccacaggcaggcaactcgggaccttgaatcagccgtttcagctt

SEQ ID NO: 2088 - DNA, 264 bp, Glycine max
  unsure (1)..(264): unsure at all n locations
caagagggtcaaaagaatcttggcaaatagtaatgcaaatgcaacatgttctagtgagaaaatcacagaccccaagagggtcaaaagaatcttgggcaaatagacaatctgcgcaaagatcaagagtgaggaaactgcaatacatatctgagcttgagcgaagtgtgacttcattacaggccgaagtttcagtgttgtctccacgggttgcattttnggatcatcaacgtttgcttctgaatgttgacaatagtgctttgaagc

SEQ ID NO: 2089 - DNA, 245 bp, Glycine max
gggatctattccttctggaaatgatcaatctaagttacaagataaagatatcaatgcaccagttgggattccttccatacctgccatacaaaagaaacctgctgttgcaattaggccatctacaagtggtcatcaagagaacagtcagatgatgaggacattgagggagagacatctatgaatgacaacacagaccctgctgatgtaaaacgagtaaggaggatgctatccaatagggagtcagc

SEQ ID NO: 2090 - DNA, 257 bp, Glycine max
gctggtcaccaacaacagttgctcaaagcatacagagatacccgttctaaagtattggaagaaagcctgcaaaagcttggagttgaaaaactaagcaaagatgatgttcaaaagctacaatgggaggttttggaagccaaaattggaaactggattcatttcatgcgtattgctgtcaaattgttgtttgctgcggaacggaaagtttgtgatcagatatttgaaggatttgactcacttggtgatcagtgttcgct

SEQ ID NO: 2091 - DNA, 273 bp, Glycine max
  unsure (1)..(273): unsure at all n locations
atnggtgaggccaatggcgtgctgagtgggcttggtgaggctgccaaagggacttttgctgagtttgagaattgtattaggaatgagacttccaagaagccggtcataaccggggatgttcatcctttgcctcgttatgttatgaattatctcaagttgcttgttgattatggtgaccctatggattcgcttctggagcttagtgaggaggatctctaatcggtttaaaantgaccttggtggtgtgggttngnagttagaggccatgtcgcc

SEQ ID NO: 2092 - DNA, 244 bp, Glycine max
cgccagtacttttccaattggttcattcaaagaatttcaatgttggagttcaagcactgatgcttcttgataaaatttcatccaaaaatcagatagcaagtgatcggttttaccgtgctttgtactctaaacttttgcttccggctgccatgtatacatccaaggcagaaatgttcattgcacttcttctcagagcaatgaaaagggatattaatttaaagcgcgtggctgcattttctaaacg

SEQ ID NO: 2093 - DNA, 267 bp, Glycine max
ccgacgaagtgagccgattggaaggcgagaacgcgcgtttggcgccgagcataaaagtgaaggaggaagcgtacgttgagatggaggccgccaacgacatcctcagagcacagaccatggaactcgccgaccggttaaggtttctgaactccattattgagatcgccgatgaggtcggcggcgaatccttcgagattccgcagattccggaccctctcttcagcgcctggcagatcccccaccctatgatggcaacgccgcctgaca

SEQ ID NO: 2094 - DNA, 264 bp, Glycine max
ctgcttgagctcgagccgattcggctcgagcggacacttgttctcagcctacagacgcacctcaccaccgacactctttctccctcactcacttaaacaatcaacactttcccaatgggttgcacggcgtccaagctagaaaacgagtacacggtgcgccgctgcaaagagcgccgccgcctgatgaaggaggcggtgtacgtgcgtgaccacctggccgccgcccattccgactactgccggtgcctccgcgtcaccggctcc

SEQ ID NO: 2095 - DNA, 256 bp, Glycine max
cggctcgagcaggaatgaagcgattacgatttggaagaggttgggggaagcgattaggggcatttttatggagctggagagtttgattcgccgggatccggcaaagattgcagttcctggtggcggacttcatccgatcactcgctatgtgatgaactacctccgtgccgcatgtcggtcacggcagatcttggagcaggtttttgaagactatggcttgaaagagtacccaaagcttgatgatagggttcttcct

SEQ ID NO: 2096 - DNA, 266 bp, Glycine max
ggaggagggaattgttgcattggagttcgacaggaagtccacgttattgtgtaaacaagaggatgagaaccttgacatagtcaagattgacaaaactcgatcaagtgttgagaagttggagtctgatttaataagcctaaggcagtgcatcagtgaaacaacttcatcaattttggaaatgatagatgaggagcttttgccccagctggttgcattaactgcggggttgacacaaatgtggaggacaatgcatgagtcccataaag

SEQ ID NO: 2097 - DNA, 263 bp, Glycine max
ctcaactcaacaacaaaacttccaactaagttccttccacgctggtagagtttacaacaccacaccagccacagaaataagtttgtggaaaataagaaaacaacattttactgttgttaccgttctacctaagaagaacaatctcaaactaatacacaacacaaaaagagttacttaagaagcatagtgtggaattattgacttaagaaatttgaaaaccactttgtcccatcccacttggacttccacctcaccccattttc

SEQ ID NO: 2098 - DNA, 171 bp, Glycine max
gaagagaatagaaattactcgctgtggcgcgacacatagccaaaacgcttggccacaacaacaccatgtctgatgacatattccaaatactatcgaacttcgatggaagattctcgagagagaatctttctgagaagggcgaagatgtggatcccatatggtgcgccgcac

SEQ ID NO: 2099 - DNA, 249 bp, Glycine max
ccggcacttgttcgtccctaaaacgcaactccaaaggccaacaacactatgaccctctcactctcagtctcactaactcccttcacttagttaaaactcaaaacactttgttttttcactttcagttcccccacgcgccaccaccaccacccatgggttgcacggcgtcgaagctggaaaacgaggacacggtgcggcggtgcaaggagcggcgccgcctcatgaaggaggcggtctacgcgcgccacc

SEQ ID NO: 2100 - DNA, 202 bp, Glycine max
gataaactaaactagcgaagagaaatgtccgataacggagaagagaaattactcgatgtggagcggcacatagcgaaaacgctgggccataacaacaccatgtgtgatgatatattccacatactatagaaccctgacggaagattatcgagagagtatctttgtgaaaaaggcgaagatgcggatcccagaggctgagctg

SEQ ID NO: 2101 - DNA, 243 bp, Glycine max
catagctgagctggaaaggaatgtacaagttttacaggcagaagggtctgaagtctcggccgagctcgagtttcttaaccagcagaatcttatcctgagtatggagaataaagcactcaagcaacgtttagaaaatatagcacaagagcagcttatcaaatatttggagcaggaagtactggaaagagagattggaagattacgtgcattgtatcagcagcagcagcaaccacagacacagcc

SEQ ID NO: 2102 - DNA, 243 bp, Glycine max
agaagggttatccgttgagattcccgagattccagatcctctcctcaagccctggcagattcctcatccgatacaaccgattatggccaccgcaaacatgtttctgcgttgatcattcctgaggatttactttaattagggttattcagtgcggtagtaactttctctgttatgtgtattatattactattagtgttatctgtctgcatcaaaagtatcgtgtggtcatcaatgcattgggtt

SEQ ID NO: 2103 - DNA, 177 bp, Glycine max
catgttatcccatttttaagtactttgagaactggtgccaggatgagaacagacatggagatttcttctctgccctgatgaaggcacagccacaatttctaaatgactggaaggcaaagttgtggactcgattcttctgtctatcggtttatgtcacaatgtatctcaatgattgcc

SEQ ID NO: 2104 - DNA, 263 bp, Glycine max
ctctgctccactttggaacgccttttggcgtgggagaagaagctctacgaggagattaaggctagagaaggtgtgaagattgaacatgaaaagaaattgtcagcactgcagactcaggaatacaaaggagaggatgaagctaagatattcaaaaccaaggcttccataaataggctgcagtcactaataagtgttacatctcaggctgtgtctaccacctcaactgccattattggccttagggactctgatcttgtccctca

SEQ ID NO: 2105 - DNA, 257 bp, Glycine max
cgcgctccgagatcggaacccggtcgaatttcgggtcgtcggtgcgggcagagtcggtggttggcgttggcggtggcggtggcgcgaagcattcgctgcggcgtcgtcggtggcggcggcggagatgaagatggtggtgagacatagggacttgagggaaatcgtggaggctattaaggagaatttcgataacgcggcttccgctggggatcaggtttctgagatgcttgagatcagtagggcgcagcttgatcgga

SEQ ID NO: 2106 - DNA, 247 bp, Glycine max
ctcgagccgcaagatgttacaagttgttgctccctctttgtcccttgtctcctcccaaccttctacttccaaagatgctgaatccgcctccgctgctaacatggattttaatgttgatctaacaaccggggcacgcaatctttcctctacgcttcagaagctccttctttgggagaagaaactctttaatgaagttaaggcggaggaaaagatgcgggtcatgcacgataggaagtgtcacaggttg

SEQ ID NO: 2107 - DNA, 251 bp, Glycine max
aaaagttgctgcacttaataagctgaagaaaaggggcacgcactctgaagcattggagaaagcaaaagcagttgtcagtcatttgcatacaagatacattgtagatatgcaatccttggattcaacagtctccgagattaaccgattacgtgatgaacagttgtatccaagacttattcagcttgttgatgggatggccactatgtggaaaaccatgctagagcaccatgtgaagcaatcagatactgtga

SEQ ID NO: 2108 - DNA, 208 bp, Glycine max
gttcatttgggtgttctccttttttagctgatccaattgggcactgagaccttccaggtgctgctgtttcctcatcctcgatctacttgcacattccctattggatagcattctcttcctcttcctctcttccatgatgtctctgtctccctcagaaccagagttttgaagagaacttgaaccagatgaataggtcccacttccacca

SEQ ID NO: 2109 - DNA, 246 bp, Glycine max
cgctgaagaggtcgagggattatccgttgagattcccgagattccagatcctctcctcaagccctggcagattcctcatcccatacaaccgattatggccaccgcaaacatgtttctgcgttgataatttcttttgctctttctcgtttggggattttagtttaattagtgtggtaacttttctctgttatgtgtattattactattagtgttatctgtttgtgtcaaaaatatcgtgtggtccgc

SEQ ID NO: 2110 - DNA, 251 bp, Glycine max
gtcgccgaagctgcctccttcgccggggcagagaggtggtttgatgtcgcctgcgggtggaattgatgggaattcggcggccttcagcttggagtttggaaatggggagtttagtgggcctgaattgaagaaaatttggccaatgaaaagcttgcggagattgccttgaccgatccaaagcgtgcgaaaaggattttggccaaccggcaatcggctgcgcgatccaaagagcgaaagatgcggtacatttc

SEQ ID NO: 2111 - DNA, 268 bp, Glycine max
attgagggagagacatctatgtcctcatcatctgactgttctcttgatgatccacttgtagatggcctaattgcaacagcaggtttcttttgtatggcaggtatggaaggaatcccaactggtgcattgatatctttatcttgtaacttagattgatcatttccagaaggagtagatcctttagaagtagtctgagatccaactagagaaggattagtcggctgtgatccaccatcagaaaaaggggacattgagggagagacatctt

SEQ ID NO: 2112 - DNA, 246 bp, Glycine max
gaaatcttcttttccgggtgtatgatcaattccactgttaggcgcaggacccatttagttcaatccttctcagttgccttcctctattggttgtactacgtttcatgatttctaacccttccttagcttaataatcatctatctaaaatatcataatatcttctactagctagttttatttttattatcacaataaaatctatctgcaatatattgttatttttattttctgagaaatttgtgtct

SEQ ID NO: 2113 - DNA, 236 bp, Glycine max
attggattttggaatggaaagggtgttgtcagtagatgagatatcggagcaatactgggtggctgcatcatcttcttcatcatcatcatcatcatcgttcaagtcaaagatgaaccggagcgaatccgaatgggcctttcagcagttcctacagcaggaagctgcttcttcttcatctaattctgatcatgatgatgatcatcatcatgctaaactcaaaaaggaatccaacacca

SEQ ID NO: 2114 - DNA, 262 bp, Glycine max
ggagatttgtttcaatgagactgctaagggctgtgtgatgcagttgctgaattttggtgaggctatcgcgatttgtaagcgctcgcccgagaagttgtttcggattttggacatgtatgaggctttgagggatgctatgcctgatttgcaggccatggtttcggatgagtttgtgattggtgaggccaatggcgtgctgagtgggcttggtgaggctgccaaagggacttttgctgagtttgagaattgtattaggaatgag

SEQ ID NO: 2115 - DNA, 264 bp, Glycine max
ggaatctgtccacaaaaattagaatggcaattcaggtggttgataagatttctatgactataaataagataagggatgaagaactgtggccacagctgaaggaattaatccaggggttgaccagaatgtggaaatccatgcttgaatgtcatcatgatcagtgtgaagcaattagagaagccagaatactgggttccattggatccaggaagaagagcgtgatagtcatctccaggcaaccaagcagctcgaacaagagcttat

SEQ ID NO: 2116 - DNA, 250 bp, Glycine max
tgcgacagtgtcagggacacggtcaagtgcaagtttccattcatcgaaaaacgaaccgagactgcatccaaggaacttgagaaaaaggcttcctctctgagaaaccttgagaggaagttctacagctcatattctatggtaggcattagccttcctgattctgcacctgacaatggacaagttttggatgcacgcgacccacttgctgagaaaaaactggaactggcaacctgccaaaggcgtgttgaag

SEQ ID NO: 2117 - DNA, 262 bp, Glycine max
agaggtgtcatctcgatcctcctcatccagaaaccctttaggagcaaactcaattgacaatgctcgaggaccatgcaaataatctctttgataattcttgtatgatctccggaagtcatgcatcaaccttggataggctatatgcttgggaaaggaaactctatgatgaagtgaaggctagtgagatagtcagaaaggaatatgacatgaagtgtaaattcttaaggcaactggaatcaaaaggagaaaagacctctacagt

SEQ ID NO: 2118 - DNA, 240 bp, Glycine max
ctcgagtggagggtgatgaagatgaagatgactctgatgatatcgagaatgagttcaattatgcccaaggaaaagccaaggccaggcgccagtgggaagatgacgctgacctgtcgtcgtcttctagacgcgaatctcaacagccaattcccctcctcaccaatggccaaacgatgtctggtgagattccgtgtgccacacctgatactcaatctgtgcgaactacttcaggtcctttgg

SEQ ID NO: 2119 - DNA, 239 bp, Glycine max
gtaatattagctgtgtatgtattggccagtatatgaactcttcatcaactcaactagtcctcacgaaaaggatgggtatatatgatccattccatcaagtgaacatgtggggggacagctttaaaattgatggaagcttgaactcaattgctccccaaatgttgatgattaagcctagcatgcggaacaagtctgaatgtactcctcacgaatcaagggaaccttctggagatgatcaa

SEQ ID NO: 2120 - DNA, 245 bp, Glycine max
caagttctggatctgaaggaggagatccgcatatcatcgatgagaggaagcggaagaggatgctgtcgaaccgcgagtcggcgcggcgatcgcggatgaggaagcagaaacagctggaggatctgaccgatgaagttagcagattgcaaagcgcgaacaagaagcttgcggagaacatagaggccaaggaagaagcgtgcgtcgagaccgaagcggcgaacagcattctgagagcacagacaatg

SEQ ID NO: 2121 - DNA, 252 bp, Glycine max
agagaaaagcgcgctatatacaagaacttgagcgcaaggttcagactcttcagacggaagccacaactctttctgcccaattgacattataccagagggacacatctggccttagtactgaaaatacagagcttaagctccgtctgcaagccatggagcaacaagcacagcttcgcgatgctcttaatgaagcattgaagaaggaagttgagagacttaaggttgctaccggtgaggggatgagccacactg

SEQ ID NO: 2122 - DNA, 252 bp, Glycine max
gggctctgaatgaggagttaactagaaaagttgtcactttggtggcagagaatgaaaacctaaagagggagaaagaattggctttgaaagagtatgagtctttggagactacaaataagaacttgaagacacagatagccaagtcaataaacactgaagtggagaaaactcctgttgagcctgtgtcatctgtggctgagataacaccttcatccggtaatggtccatggttcctttataacctttttccag

SEQ ID NO: 2123 - DNA, 256 bp, Glycine max
gaattaattgatgaatgagattcaaatactaattgttgctatcacaattcacaagagattggattttggaatggaaagggtgttgtcagtagatgagatatcggagcaatactgggtggctgcatcatcttcttcatcatcatcatcatcatcgttcaagtcaaagatgaaccggagcgaatccgaatgggcctttcagcagttcctacagcaggaagctgcttcttcttcatctaattctgatcatgatgatgat

SEQ ID NO: 2124 - DNA, 260 bp, Glycine max
  unsure (1)..(260): unsure at all n locations
aaagtattgtgcagcaaagtacagagattgaagggaagggagctgatggaaaagatcgngacttgtncaaaaaattgnaaggaacttctgcaaatacaggttccaaagcangagaaagnngaaaggcaggctcaggttcaggcaatgatggcatatccgcaaagtgcnngaaagtggttcanagggttcatcaaatgctagtgatganaatactaaccaacaggaatnagctgcaaaaaagaanggaantttganctgat

SEQ ID NO: 2125 - DNA, 252 bp, Glycine max
gggtactgtgcttggaaatatgatgggagattcttggttaagagcacacgagcaatataaggactattatgcagcactttatttgaggaccagctggggaaagcttctatctattcttgtagttccaagggacatactttcaccctccagtgcaagtgtgacaagccaagacttggcaaagagactaaatgctttcaatctagcttttgatgaaaggtacaagaagcaatctaattgggtaatatccgatga

SEQ ID NO: 2126 - DNA, 271 bp, Glycine max
  unsure (1)..(271): unsure at all n locations
gtcgaagctttatgaggacagtgcaatgcagcaggtgtttttgatgaacaatctttattacctagtgcggaaagtgaaggactcggacctagggaaggtcttgggggataattggattaggaaacgccgtggtcagatacgccagtatgctacagggtatctcagancctcttggagcagggccttatctgtttgaaggatgaagggattggagggagctccaataatggcatcanagatggcttgaaggagaggttcaagagtttcatgc

SEQ ID NO: 2127 - DNA, 245 bp, Glycine max
  unsure (1)..(245): unsure at all n locations
gnaaantcaagagngtcatcagantcacatgtggnattggactctcgtcttctatcatctctcctaactggngtgaatagagcatttccttttgtctcaagtaatgaagctgatgacattgttgacattcaaacaccagtacttttccaattggttcattcaaagaatttcaatgttggagttcaagcactgatgcttcttgataaaatttcatccaaaaatcagatagccagtgatcggtttta

SEQ ID NO: 2128 - DNA, 282 bp, Glycine max
  unsure (1)..(282): unsure at all n locations
cgcagaataaggatctagagagaaaggtgagaaatatggatagagatgaccagaagctgcagaagcaaattcaagcgttagagcgaaaggtggttctggtatctggagaaggtaaaggtctctcagtttctgagaatatcatatatcagagtgacaaaagcagcagtctacaggctagcttacagtgcatttttgaggccatgggagatttactgatgaaactgtgagagcttatgaggngttgctacaacggagcaaagaagaaatgctgcccggatcacg

SEQ ID NO: 2129 - DNA, 266 bp, Glycine max
aaccatctcaaaatggaagttcagtacatgctcctcaaaatggggtacataatagacctcagacagttgttaatcaaactatgtctatcttacctatatctaccacaagtgctcctggagcagttcctggtcccacaactaatttaaatataggaatggattattggggcacaccaacttcgtccaccattcctgcattgcatggaaaggttccttctactgcagttgctggagggatgattgctgctggatcacgagatggtgtt

SEQ ID NO: 2130 - DNA, 153 bp, Glycine max
  unsure (1)..(153): unsure at all n locations
ccgcggatccgcgattcagctgctgaatttcgcggacgccgtcgcaatcggganccggtncgccggaacggtgttcagaatcctcgacgtgttcgagacgacgcgtgacctaattccggagtttgangctctgttttcggaccagttcagtgt

SEQ ID NO: 2131 - DNA, 267 bp, Glycine max
  unsure (1)..(267): unsure at all n locations
ggcggactcggcgatgataatggacggtgtgaagaaagctatggctcctgataaacttgctgaacttgctcttatggatcccaagagagctaagaggattcttgctaacaggcaatctgctgcaagatccaaggagaggaagattcgttacacaagtgagttggagaggaaggtgcagactcttcagactgaagcaactaacctttcctgcacagcttaccatgcttcagagagacactacagatttgactcacagagaataaggng

SEQ ID NO: 2132 - DNA, 209 bp, Glycine max
  unsure (1)..(209): unsure at all n locations
cnagtaccgtagaatagaaaatgtaggctactggttaatattacanncanatgacatgtnnnatcannagggnaattanatgncattngtttgnccatattaaccagtaccgtagaatagaaaatgtaggctacttgagcactttttgtntagaacttagtattgcaagtgatgttaagaatcctgcttcacncttcanatctcatagt

SEQ ID NO: 2133 - DNA, 280 bp, Glycine max
  unsure (1)..(280): unsure at all n locations
tcagcntctcgagtgggagcagctcgagaacaaaatcagacgctggatacgcgccgccaaggtctgcgtcagaacgctcttcgccagcgagaagaagctctgcgagcaaatcttcgacggtgtcggaacttccatcgacgacgcctgcnctcatggagacggtgaaaggtcccgcgattcagctcttcaacttcgcggaagcaattagcataagccgtagtcgcggagaagngttcaagattctcgatttgcatgacgcgttgaaggatttgatgccgga

SEQ ID NO: 2134 - DNA, 266 bp, Glycine max
attgctgctggatcacgagatggcgttcagccacaagtttggctgcaggacgaaagagagcttaaaagacaaagacggaaacagtctaatcgggagtctgcacgcagatccaggttacggagcaggccgaatgtgatgaactagctcagcgtgctgaagctttgaaagaagaaaatgccagtctccgatcagaagtgagccggatcaggagtgagtatgagcagctacgttctgagaatgctgccctcaaggatagacttggggag

SEQ ID NO: 2135 - DNA, 232 bp, Glycine max
gatgagtggatgaattaattgatgaatgaaattcacatactaattgttgctatcacaattcacaagagcttggattttggaatggaaagggtgttgtcagtagatgagatatcggagcaatactgggtggctgcatcatcttcttcatcatcatcatcatcatcgttcaagtcaaagatgaaccggagcgaatccgaatgggcctttcagcagttcctacagcaggaagctg

SEQ ID NO: 2136 - DNA, 235 bp, Glycine max
gatgagtggatgaattaattgatgaatgaaattcaaatactaattgttgctatcacaattcacaagagattggattttggaatggaaagggtgttgtcagtagatgagatatcggagcaatactgggtggctgcatcatcttcttcatcatcatcatcatcatcgttcaagtcaaagatgaaccggagcgaatccgaatgggcctttcagcagttcctacagcaggaagctgctt

SEQ ID NO: 2137 - DNA, 281 bp, Glycine max
acgctgactgcatgatatcttccggttatgcgaaggaatgcgtcacgtctacatcttaattcgaaaatctatcatcgacgaaggaatctaccgcctcggcgtggagaaccttagctcctcgcgcgctaacaagatggattgggaagttcttgatttgaagatcaagagttggttagaggcgacaaggatttccgttagaacactctttaacggagagagaatactctgcgaccacgtcttcagttactcagattccgtcagagaatcatgcttcgccgaga

SEQ ID NO: 2138 - DNA, 256 bp, Glycine max
gacaaccagagtcatccatggccaagcccaatccacacactgaagccccttctgcacctgagccacccaaagctgtaaagcgagagggcaatcgcaagggaacaacatcaagctctgagcaggaagcacccaaaacaccagatcctaagacactaagaagacttgctcagaatagagaagcagcaaggaaaagcaggctcaggaaaaaggcgtacgttcagcaactagagtcaagtaggattaagcttaatcagat

SEQ ID NO: 2139 - DNA, 295 bp, Glycine max
ctatcctgcgtcttcttcctccgccgccgacgtcgtattcgtcgagatcgaagatcaacctaaacccgcccctccccctccgacaaacggcgccgttctccccaatgcccctggtcccgtcccccttgactccgacgaataccaggccttcctcaagagcaagctaacctcgcatgcgccgccgtcgccatgactaggggatctttggctaaatctcaagacccgtcccctttttctgaaggtggatcacagccgactaatccttctctagttgaatctcagactacttctaaag

SEQ ID NO: 2140 - DNA, 224 bp, Glycine max
ctaattccggagtttgaggctctgttttcggaccagttcagtgtgtcgctcaggaatgaagcgattactatttggaggaggttgggggaagctattaggggcatttttatggagctggagaatttgattcgccgggatccagcgaagatggcggttcccggtggcggtctccatccgatcactcgctacgtgatgaactaccttcgtgctgcgtgccggtcacg

SEQ ID NO: 2141 - DNA, 279 bp, Glycine max
gttttcacctgaacaatcggagctacatagaccgacatgtggatccgtacggattgggacctattggctatgattggctccaaaaaaacaaaagaaaaatagaaaaaaactataaactctatctgacaaagtcatggactaagattttcaactttttgaagttggacatcaatgaggcagaggctaatgttgcggtcaagttaatgacagacaagctccgttccttcaaccaacactttgatgatatatgcaacgatcagtctacgtggcttgtctttg

SEQ ID NO: 2142 - DNA, 259 bp, Glycine max
gatttgtaagcggtcgccagagaagttgtttcgcattttggacatgtatgaggctttgagggatgctatgcctgatttgcaggcaatggtttctgatgagtttgtgattggtgaggccaatggagtgctgagtgggcttggtgaggctgcaaaagggacttttgctgagtttgagaattgtattaggaatgagacttccaagaagccggtcataaccggggatgttcatcctttgcctcgttatgttatgaattatctc

SEQ ID NO: 2143 - DNA, 291 bp, Glycine max
  unsure (1)..(291): unsure at all n locations
ncgaatcgtgaggctgccaggaaaagccgactgaggaaaaaggcatatgtgcaacaattagagagcagtaggttgaaactgacccaacttgagcaggagctccagcgatctcgccagcagggaatatttatttcaagtactggagatcaggcacagtcaatgagtggaaatggtacttaaccattgtgtacctccgattgtatgttttgagggttaaacatattggagtagttttaggggatgttttgaggctgataataataatccatagtcagtgcaaaaacgattgac

SEQ ID NO: 2144 - DNA, 295 bp, Glycine max
attcggctcgaggcagatgcttcgggaaatgccccaggccgcatcgaagttggtggtaaacctcctgaagtgaaggaacaattacctatcaaaagatcaaaaggaagtgctagtggtggtaatttgaatatgtggattacagggaacaataatgaacctggtaaaataccaggagaatctgctaatgggattcattccacaagtggtgagagtgcaagtgacggaactagtgaaggaagtgatgagcactcccagaatgattctcacttgaaatcaagggagaggcaggactctt

SEQ ID NO: 2145 - DNA, 263 bp, Glycine max
gcagatccaggttacggaagcaggctgaatgtgatgaactagctcagcgtgctgaagctttgaaagaagaaaatgccactctccgatcagaagtgagccagatcaggagtgagtatgagcagctacgttctgagaatgctgccctcaaggagagacttggggacatacctggtgtcgcgacgcctgggaaggaggatcttaggtctggtcagaatgatcagcatgtgagtaatgacactcaacagagtggtcagacagaggtt

SEQ ID NO: 2146 - DNA, 272 bp, Glycine max
gctatccaatagggagtcagcccgtcgctctagaagaagaaagcaggctcatttaactgacctagaaacacaggtttctcaattaagaggtgaaaattctaccttgttaaagcgccttactgatgttagtcagaaatacagcgactctgctgttgacaacagagttttaaaagctgatgttgaaacattaagagcaaaggtgaagatggctgaagagaccgtcaaaagaattactgggttgaacccaatgcctcatgccatgtctgatatat

SEQ ID NO: 2147 - DNA, 217 bp, Glycine max
ctgggaggtgagaatcaaactctcagagaagagcttcagagactttctgaagaatgcgagaagcttacatccgaaaataattctatcaaggaagagttggagcggttgtgtggtccagaagcagttgctaacctggattaaacagcaacacatttcagtccctcagtgtagtgtttgatggtacgggaaaatttggaaagttccttaattaagacga

SEQ ID NO: 2148 - DNA, 279 bp, Glycine max
atgacagaaggggggagatgagtggatgaattaattgatgaatgaaattcaaatactaattgttgctgtcacaattcacaagagattggattttggaatggaaagggtgttgtcagtagatgagatatcggagcaatactgggtggctgcatcatcttcttcatcatcatcatcatcatcgttcaagtcaaagatgaaccggagcgaatccgaatgggcctttcagcagttcctacagcaggaagctgcttcttcttcatctaattctgatcatgatga

SEQ ID NO: 2149 - DNA, 268 bp, Glycine max
tctcgagccgaatcggctcgagacgacagaaggggactgattataatattaaattttgaaagtgccataatgcgtgacttacactaatattttcataaactgtggacaaactttttgatgtagactggaattcttttatgtcaaactcgtatgcaatttcatcattactattatgaaggatgctttctaatagggggtcagccagacgttcaagaaggagaaagcaggctcatttaactgagctggagacacaggtctcccaattacg

SEQ ID NO: 2150 - DNA, 273 bp, Glycine max
cggctcgagcggctcgagcggctcgagttctaatagctactgcttcgttagaagtgcaaaaattaaatgtccaacatcttctagttgatgtttgagattcatgtatccgattctcagtgaaatcttcttttccgggtgtatgatcaattccactgttaggcgcaggacccatttagttcaatccttctcagttgctttcctctattggttgtactacgtttcatgatttctaaaccttccttagtctaataatcatctactactagctattat

SEQ ID NO: 2151 - DNA, 255 bp, Glycine max
ctcatttccatgacttcaaccctcctgtctcaaaaaattataaaatatacggctctaaatgaagcactgaagaacgaagttgataggctcaagattgcaactggagagatagtaatgcataccgatgcctatggtttgggactgcatccacttacatattctcaagctccattcttctcacatcagtcacaacatgggcagagagaacttcaggccatgaaaatgtggtagttgcattcactctcatctaatgtg

SEQ ID NO: 2152 - DNA, 263 bp, Glycine max
ctcgagcgaatcggctcgaggtctcactaactcccttcactcagttaaaactcaaaacactttgttttttcactttcagttcccccacgcgccaccacacccacccatgggttgcacggcgtcgaagctgcaaaacgaggacacggtgcggcggtgcaaggagcggcgccgcctcatgaaggaggcggtctacgcgcgccaccacctcgctgctgcccactccgactactgcccgtctgtccgcctcaccggctccgccctct

SEQ ID NO: 2153 - DNA, 288 bp, Glycine max
  unsure (1)..(288): unsure at all n locations
ggtgttctcagtggacgatatctccgatcacttctggcagccgcctatccctgtctccgccgcccaaacttcctcccagatgagccgcngcgcctccgagtgggccttccaacgcttcctccaggaagcttccgcctccgcaccctctcctccgtcttcttcctccgccgccgacgtcgtattcgtcgagatcgaagatcaacctaaacccgcccctccccctccgtcaaacgggccgttctccccaatgcccctggtcccgtcccccttgatccgacgaataccagg

SEQ ID NO: 2154 - DNA, 252 bp, Glycine max
gaagactatggcttgaaagagtatacaaagcttgaggatacggttccttcctcttcttctctgtcagtgcaaatggattggattatggaactgttagaaagcaatttggaagcaaagtccaggatttacaagtaccctgctttgcgctatgttttcttgatgaataatgggaggtacattgttcagaagaccaaagatagtgaattgggaacccttttgggagatgattggatcagaaaacacgctgcaaaa

SEQ ID NO: 2155 - DNA, 246 bp, Glycine max
ctcgagccgagcaaagtccaggatttacaaggaccctgctttgcgctatgttttcttgatagataatgggaggtacattgttcagaagaccaaagatagtgaattgggaacccttttgggagatgattggatcagaaaacacgctgcaaaagttaggcaattccatgtgcactatcaaagatgctcgtggactaaggtattagggattttgaagcttgatagtaatggctcatcattgccccctaa

SEQ ID NO: 2156 - DNA, 264 bp, Glycine max
gaacaatgggaggtacattgttcagaagaccaaagatagtgaattgggaaccctcttgggagaagattggatcagaaaacacgctgcaaaagttaggcaattccatgtgcactatcaaagaagctcgtggaataagctattagggattctgaagttggatagtaatgggtcaatgccccatattaacttggcaaagtcaatgaaggagaaactcaagtcgtttaacacagtttttgaggagatatgcaaggaacagtcttcatg

SEQ ID NO: 2157 - DNA, 267 bp, Glycine max
tgttggagagcaatttggaagcaaagtccaaaatttacaaggaccctgctttgtgttatattttcttgatgaacaatgggaggtacattgttcagaagaccaaagatagtgaattgggaaccctcttgggagaagattggatcagaaaacacgctgcaaaagttaggcaattccatgtgcactatcaaagaagctcgtggaataagctattagggatcctgaagttggatagtaatgggtcaatgccccatattaacttggcaaagt

SEQ ID NO: 2158 - DNA, 387 bp, Glycine max
gcttgaaagagtacccaaagcttgatgatagggttccttcctcttcttctctgtcagtgcagatggattggattatggaactgttggagagcaatttggaagcaaagtccaaaatttacaaggaccctgctttgtgttatattttcttgatgaacaatgggaggtacattgttcagaagaccaaagatagtgaattgggaaccctcttgggagaagattggatcagaaaacacgctgcaaaagttaggcaattccatgtgcactatcaaagaagctcgtggaataagctattagggattctgaagttggatagtaatgggtcaatgccccatattaacttggcaaagtcaatgaaggagaaactcaagtcgtttaacacagtttttg

SEQ ID NO: 2159 - DNA, 279 bp, Glycine max
  unsure (1)..(279): unsure at all n locations
tcagcctcaacttcaacctttcttcacttcccttcacatggcagctcttgtgaaaccaatttccaatgtcactcccaaatttgtcagcagccccagaatgggctcatcacactcctccaaattcagcaccataataagaatgtntnccactgccaccccaccaccatccacctccacaaagccagcaagcagcaagaagggcaatatcaaggagaccctcttgactccaagattctacaccactgactttgatgagatggagacactcttcaacactga

SEQ ID NO: 2160 - DNA, 263 bp, Glycine max
cttcccttcacattgcagaagagatggctcttgtgaaaccaatttccaatgtcactcccaaatttggcagcagccccagaatgggatcacactccaaattcagcaccataataagaatgtctgccactgccaccccaccaccaccaccctccacctccacaaagccagctgcaagcaacaagaagggcaacatcaaggagaccctcttgactccaaggttctacaccactgactttgatgagatggagaccctcttcaacact

SEQ ID NO: 2161 - DNA, 242 bp, Glycine max
cgagatggctcttgtgaaaccaatttccaatgtcactcccaaatttggcagcagccccagaatgggatcacactccaaattcagcaccataataagaatgtctgccactgccaccccaccaccaccaccctccacctccacaaagccagctgcaagcaacaagaagggcaacatcaaggagaccctcttgactccaaggttctacaccactgactttgatgagatggagaccctcttcaaca

SEQ ID NO: 2162 - DNA, 271 bp, Glycine max
gtcctcctcagcctcaacttcaacctttcttcacttcccttcacatggcagctcttgtgaaaccaatttccaatgtcactcccaaatttgtcagcagccccagaatgggctcatcacactcctccaaattcagcaccataataagaatgtctgccactgccaccccaccaccatccacctccacaaagccagcaagcagcaagaagggcaatatcaaggagaccctcttgactccaagattctacaccactgactttgatgagatggagac

SEQ ID NO: 2163 - DNA, 279 bp, Glycine max
  unsure (1)..(279): unsure at all n locations
cttcttcanttcccttcacattgcagaagagatggctcttgtgaanccaatttccantgtcactcccaaatttggcagcagccccagaatgggatcacactccaaattcagcaccataataagaatgtctgccactgccaccccaccaccaccaccctccacctccacaaagccagctgcaagcaacaagaagggcaacatcaaggagaccctcttgactccaaggttctacaccactgactttgntgagatggagaccctcttcaacactgagatcaa

SEQ ID NO: 2164 - DNA, 290 bp, Glycine max
ctcaacttcaacctttcttcacttcccttcacatggcagctcttgtgaaaccaatttccaatgtcactcccaaatttgtcagcagccccagaatgggctcatcacactcctccaaattcagcaccataataagaatgtctgccactgccaccccaccaccatccacctccacaaagccagcaagcagcaagaagggcaatatcaaggagaccctcttgactccaagattctacaccactgactttgatgagatggagacactcttcaacactgagatcaacaaaaacctc

SEQ ID NO: 2165 - DNA, 274 bp, Glycine max
aaccacccttcttcacttcccttcacattgcagaagagatggctcttgtgaaaccaatttccaatgtcactcccaaatttggcagcagccccagaatgggatcacactccaaattcagcaccataataagaatgtctgccaatgcaaccccaccacaacaaccctcaacctccacaaagccagctgcaagcaacaagaagggcaacatcaaggagaccctcttgactccaaggttctacaccactgactttgatgagatggagaccctcttcaa

SEQ ID NO: 2166 - DNA, 251 bp, Glycine max
gagtttcaatgcttgttttgaagaaatttacagggttcagacagcttggaaggtaccggatgaccagcttcgggaggagctgcggatatctatatcagaaaaggtgattcctgcataccgctcgtttgtgggaagatttaggtgtcagttagagggaaggcatgttgggaagtacattaagtatacaccagaggatctagagacctatctattagatttatttgaaggatcccctgctgtattgcatcaca

SEQ ID NO: 2167 - DNA, 239 bp, Glycine max
ttaggtttcaatgcttgttctgaagaaatttacagggttcagacagcttggaaggtaccggatgatcagcttcgggaggagctgcggttatctatatcagagtaggtgattcctgcatatcgctcgtttgtgggattgtttaggattcagttatagggaaggcatgtgtggaagtacattaagtctacaccagaggatttagagacctatctattagatttatttgacggatccccggc

SEQ ID NO: 2168 - DNA, 192 bp, Glycine max
  unsure (1)..(192): unsure at all n locations
ggaancatgnctcntgttgatgcaaaacgagtaaggaggatgctttctaatagggagtcagccagacgctcaagaagaagaaagcaggctcatttaactgagctggagacacaggtctcccaattaagaagcgaaaattcttcattgttaaagcgtttcacggatgtgagccagaaatacagtaatgctgcc

SEQ ID NO: 2169 - DNA, 289 bp, Glycine max
gctttctaatagggagtcagccagacgctcaagaagaagaaagcaggctcatttaactgagctggagacacaggtctcccaattaagaagcgaaaattcttcattgttaaagcgcttcacggatgtgagccagaaatacagtaatgctgcagttgacaacagagtactgaaagctgatgttgaaacattaagagcaaaggtaaatccttgcctttagtatataggccttaagtagaacctgttacataggagacctactgactcttgctaagcagttccctaggtttgg

SEQ ID NO: 2170 - DNA, 283 bp, Glycine max
tcatgaactaaccccctctcaatcccctaatttctccaacatttccccctttttctaattaatcagatctgcaaaaccctaatttccctaaccctaacgaaacccccaaatccaatggcttcgattcaacgcccggcgagttcgggatcgtcggagggaggagatccggtgatgtacgagaggaagaggaagcgtatggagtcgaaccgcgagtccgcccggcgatcgcggatgaagaagcagaagcagctcgaagacctaaccgacgagtgagccgattgga

SEQ ID NO: 2171 - DNA, 267 bp, Glycine max
ctaatttctccaacatttccccctttttctaattaatcagatactgcaaaaccctaatttccctaaccctaacgaaacccccaaatccaatggcttcgattcaacgcccggcgagttcgggatcgtcggagggaggagatccggtgatgtacgagaggaagaggaagcgtatggagtcgaaccgcgagtccgcccggcgatcgcggatgaagaagcagaagcagctcgaagacctaaccgacgaagtgagccgattggaaggcgaga

SEQ ID NO: 2172 - DNA, 236 bp, Glycine max
cgctccgccatccgaactcctcaagcttcttctaagtcagttggaacctttagccgagcaacaattgatgggcatctacaacttgcagcaatcatcccagcagactgaagatgctctttcccaagggatggatgcattgcagcaatcactatctgagacattggctaatggttcgcccagctcatcaggctcctcgggaaatgtggcaaattacatggggcaaatggctatggcca

SEQ ID NO: 2173 - DNA, 218 bp, Glycine max
ctttcggtcatccgaactcctcaagcttcttctaagtcagttggagcctttagccgagcaacaattgatgggcatctacaacttgcagcaatcatcccagcagactgaagatgctctttcccaagggatggatgcattgcagcaatcactatctgagacattggctaatggttcgcccagctcatcaggctcctcgggaaatgtggcaaattacatgg

SEQ ID NO: 2174 - DNA, 274 bp, Glycine max
agcatagtcaatccatggacgggtcaaccaccatcaagcctgagttgctggtctcgggttcggaagacatgtcggcggctgattccaaaaaagcaatatcagctgccaagcttgctgagcttgccttgattgaccccaaacgtgcaaaaaggatatgggcaaataggcagtctgctgcgaggtcaaaagagagaaagatgcgatacattgctgagcttgaaaggaaggtgcaaacattgcaaacagaagcaacatctttgtctgcacaattaac

SEQ ID NO: 2175 - DNA, 273 bp, Glycine max
  unsure (1)..(273): unsure at all n locations
agcatagtcaatccatggacgggtcaaccaccatcaagcctgagttgctggtctcgggttcggaagacatgtcggcggctgattccaaaaaagcaatatcagctgccaagcttgctgagcttgccttgattgaccccaaacgtgcaaaaaggatatgggcaaataggcagtctgctgcgaggtcaaaagtcagaaagatgcgatacattgctgagcttgaaaggaaggtgcanacattgcaaacagaagcaacatctttgtctgcacaattaa

SEQ ID NO: 2176 - DNA, 251 bp, Glycine max
caaacgtgcaaaaaggatatgggcaaataggcagtctgctgcgaggtcaaaagagagaaagatgcgatacattgctgagcttgaaaggaaggtgcaaacattgcaaacagaagcaacatctttgtctgcacaattaactctacttgcagagagatacaaatggcttaaattctgagaacagtgaactgaagctgcggttgcaaaccatggagcaacaagttcacttgcaagatgcattaaacgatgcatta

SEQ ID NO: 2177 - DNA, 205 bp, Glycine max
cagctgccaagcttgctgaacttgccttgattgaccccaaacgtgcaaaaaggatatgggcaaataggcagtctgctgcaaggtcaaaagagagaaagatgcgatacattgctgagcttgaaaggaaggtgcaaacattgcaaacggaagcaacatctttgtctgcacaattaactctcttgcagagagatacaaatggcttaaa

SEQ ID NO: 2178 - DNA, 283 bp, Glycine max
  unsure (1)..(283): unsure at all n locations
cttttaagatatttttggtcacatagtttatggtctgcctctgcntagtgcttcaacagccccctgctcgctcgatcatcttgattattttttaagccttttaaatgcccaacatcttgttcttgatgtttgagattgatgtatccaattcttagtgaaatcttcttttccgggtgtatgatcaattctactgtgagacgacgcaggacccatttagttcaatccttctccgttgcttttctttactggctctactacgtttcatgatttctaattattatta

SEQ ID NO: 2179 - DNA, 269 bp, Glycine max
cttttaagatatttttggtcacatagtttatggtctgcctctgcgtagtgcttcaacagccccctgctcgctcgatcatcttgattattttttaagccttttaaatgcccaacatcttgttcttgatgtttgagattgatgtatccaattcttagtgaaatcttcttttccgggtgtatgatcaattctactgtgagacgacgcaggacccatttagttcaatccttctccgttgcttttctttactggctctactacgtttcatgatt

SEQ ID NO: 2180 - DNA, 286 bp, Glycine max
  unsure (1)..(286): unsure at all n locations
cttttaagatatttttggtcacatagtttatggtctgcctctgcgtagtgcttcaacagcccccttgctcgcttcgatcatcttgattattttttaagccttttaaatgcccaacatcttgttcttgatgtttgagattgatgtatccaattcttagtgaaatcttcttttccgggtgtatgatcaattctactgtgagacgacgcagcncccatttagttcaatccttctccgttgcttttctttactggctctactacgtttcatgatttctaattattattaa

SEQ ID NO: 2181 - DNA, 284 bp, Glycine max
  unsure (1)..(284): unsure at all n locations
cgtacagctttctatgaaggcattggacttaacacaaaagaatttgacatgcatgtcatcatcgagacaaaccgcacaactgctaggattttcccagctgttcttgatgttgaaaacccagagttcaagcggaagttggaccggatggtggagataaacgagaagattattgctgttggggagaagtgatgacatagcggtggtgaagaacttgaagaggatcccactggttgctgcattggtgtctgaactcttggcaacatatctaatgcctccantgagtc

SEQ ID NO: 2182 - DNA, 273 bp, Glycine max
  unsure (1)..(273): unsure at all n locations
cntacagctttctatgaaggcattggacttaacacaaaagaatttgacatgcatgtgcatcatcgagacaaaccgcacaactgctaggattttcccagctgttcttgatgttgaaaacccagagttcaagcggaagttggaccggatggtggagataaacgagaagattattgctgttggggagagtgatgacatagcggtggtgaagaacttgaagaggatcccactggttgctgcattggtgtctgaactcttggcaacatatctaatgcc

SEQ ID NO: 2183 - DNA, 186 bp, Glycine max
ctcaatgattgccaacgtacagctttctatgaaggcattggacttaacacaaaagaatttgacatgcatgtcatcatcgagacaaaccgcacaactgctaggattttcccagctgttcttgatgttgaaaacccagagttcaagcggaagttggaccggatggtggagataaacgagaagattatt

SEQ ID NO: 2184 - DNA, 282 bp, Glycine max
aaagaatttgacatgcatgtcatcatcgagacaaaccgcacaactgctaggattttcccagctgttcttgatgttgaaaacccagagttcaagcggaagttggaccggatggtggagataaacgagaagattattgctgttggggagagtgatgacatagcggtggtgaagaacttgaagaggaacccactggttgctgcattggtgtctgaactcttggcaacatatctaatgcctccaattgagtcagggtctgtagatttggcagagtttgaaccacaa

SEQ ID NO: 2185 - DNA, 240 bp, Glycine max
attggaatggacttgtggaatgcatcttctggtggcgctgaagctgcaaaaatgagacataatcaatctggtgccccgggagttgcccttggtgatcaatgggtacaagatgaacgtgagctgaaaagacagaagaggaaacagtcaaaccgagagtcagccaggaggtcaagattacgcaagcaggctgagtgtgaagagttacaaaagagggtggaatcgctgggaggtgagaatcaa

SEQ ID NO: 2186 - DNA, 242 bp, Glycine max
attggaatggacttgtggaatgcatcttctggtggcgctgaagctgcaaaaatgagacataatcaatctggtgccccgggagttgcccttggtgatcaatgggtacaagatgaacgtgagctgaaaagacagaagaggaaacagtcaaaccgagagtcagccaggaggtcaagattacgcaagcaggctgagtgtgaagagttacaaaagagggtggaatcgctgggaggtgagaatcaaac

SEQ ID NO: 2187 - DNA, 256 bp, Glycine max
agcaactaatcttaacattggaatggacttgtggaatgcatcttctggtggcgctgaagctgcaaaaatgagacataatcaatctggtgccccgggagttgcccttggtgatcaatgggtacaagatgaacgtgagctgaaaagacagaagaggaaacagtcaaaccgagagtcagccaggaggtcaagattacgcaagcaggctgagtgtgaagagttacaaaagacggtggaatcgctgggaggtgagaatcaa

SEQ ID NO: 2188 - DNA, 345 bp, Glycine max
  unsure (1)..(345): unsure at all n locations
cacaattaaccatgaagtgagagatacagatatgtctgaagcagctgctgaagatcccgagttggctctagctctccaattgtcagtagaagacagctcaaaggactcggcaagccagtctgacgtgagtaaactgttggcagatcagtcctttgtatcttctatccttgcatcgcttcctggggttgacccaaatgacccatctgtcaaagatttgctggcttccatgcaaaatcagtctgagccacagcagaagaatgaagacaagccaccanatgaagaggagaaaaaataatcttaatagtctcattgtggttcatttgtagtatcctttggtaggcatat

SEQ ID NO: 2189 - DNA, 282 bp, Glycine max
gagaactgatttgacggacgatgagaatgctcttctacagcaggcccatgcaatgtcaatggatgatcccacaattaaccatgaagtgagagatacagatatgtctgaagcagctgctgaagatcccgagttggctctagctctccaattgtcagtagaagacagctcaaaggactcggcaagccagtctgacgtgagtaaactgttggcagatcagtcctttgtatcttctatccttgcatcgcttcctggggttgacccaaatgacccatctgtcaaaga

SEQ ID NO: 2190 - DNA, 272 bp, Glycine max
tttttcacaggactctcaattaaaatcagggggccggcaggattcttttgaagatgaaccctctcaaaatggcagttcagcatatactcctcaaaatgggggactaaatatacctcatacagtggtcaatcaaaccatgtctatcatacctatctctgcaggtggtgctcctggagctgttcctggtcccacgacaaacttaaatataggaatggattattggggtacaccaggttcatccaacattcctggacttggcagaaaggttccat

SEQ ID NO: 2191 - DNA, 260 bp, Glycine max
aattgaaatctgggggcaggcaggattcttttgaagatgaaccatctcaaaatggcagtttggcatatactgctcaaaatgggggactaaatacacctcatacagtagtcaatcaaactatgtctatcatacctatctctgcaggtggtgctcctggagctgttcctggtcccacgacaaacttaaatataggaatggattattggggtacaccagcttcatccaacattcctgcacttggcagaaaggttccatctact

SEQ ID NO: 2192 - DNA, 335 bp, Glycine max
cgacaatcaagccagtcagacatgagcaaattgttagctgatcaatcctttgtatcttctatccttgcatcgcttcctggggttgacccaaatgacccttctgtcaaggatttgctggcgtccatgcaaaatcagtctgagcctcaacagaagaatgacgacaagccatcaaacgaggaggagaagaagtaatctttaagagccacttttccctgtatgatttttattttgttggtagcattcttcgcggctgttgctaatcggggaactattccaatatgtctctctgcagtttaattggaacccaatgcatgtctctcgattgaatattggat

SEQ ID NO: 2193 - DNA, 255 bp, Glycine max
ggaagaggaagagaatgttgtccaatagggaatcggcacgtagatcgaggataaggaaacagcagcacctggaaggtctgagtgcccaattggatcagcttaaaaaggagaacgcacaaatcaacacaaacataagcatcacgacgcagatgtacctcaacgtggaagctgagaacgcgattctgagggctcaaatgggggaactgagcaacaggattgaactctctgaacgaaatgataagttcattaactcca

SEQ ID NO: 2194 - DNA, 272 bp, Glycine max
gggaatcggcacgtagatcgaggatgaggaaacagcagcacctggaaggtctcagtgcccaattggatcagctaaaaaaggagaacacccaaatgaacacaaacataggcatcagcacgcagctgtacctcaacgtggaagctgagaacgcgattctgagggctcaaatggaagaactgagcaagagattgaactctctgaacgaaatgataagtttgattaactccaccaccaccaccaacaactgcttgatgttcgatgaggcacaggag

SEQ ID NO: 2195 - DNA, 252 bp, Glycine max
ggaacagaggaagaggaagagaatgttgtccaatagggaatcggcacgtagatcgaggataaggaaacagcagcacctggaaggtctgagtgcccaattggatcagcttaaaaaggagaacgcacaaatcacacaaacataagcatcacgacgcagatgtacctcaacgtggaagctgagaacgcgattctgagggctcaaatgggggaactgagcaacagattgaactctctgaacgaaatgataagtttc

SEQ ID NO: 2196 - DNA, 434 bp, Glycine max
  unsure (1)..(434): unsure at all n locations
cccacgcgtccggcaatccaaatcgctttgggcaagagaatgctatccaatagggaatcggcacgtagatcgaggatgaggaaacagcagcacctggaaggtctcagtgcccaattggatcagctaaaaaaggagaacacccaaatgaacacaaacataggcatcagcacgcagctgtacctcaacgtggaagctgagaacgcgattctgagggctcaaatggaagaactgagcaagagattgaactctctgaacgaaatgataagtttgattaactccaccaccaccaccaacaactgcttgatgttcgatgaggcacaggagactacgactcagttgttcaatgattgtggcttcatggatgcttgggaatacggaataccactcaatcaacaaatcatggcttacgctgancatgacatngtgatgatgga

SEQ ID NO: 2197 - DNA, 268 bp, Glycine max
ctcagccgcaaaatcaaataaaaaatctccttctcggaaatggcgtcgtcaatccaacaacaacgctcgactgcaacaagttctggatctgaaggaggaggagatccgcaaatgatcgacgagaggaagcggaagaggatgctgtcgaaccgcgagtcggcgcggcgatcgcggatgaggaagcagaaacagctggaggatttgaccgatgaagttagcagattgcaaggcgcgaacaagaagctggcggagaacataaaggcaaagg

SEQ ID NO: 2198 - DNA, 267 bp, Glycine max
tctcgagccgaatcggctcgaggtttcttttttggttctgttatcaaatcaaataaaaaatcaccttctcggaaatggcatcaccgatccaacaacaacaacgctcgactactacaagttctggatctgaaggaggagatccgcatatcatcgatgagaggaagcggaagaggatgctgtcgaaccgcgagtcggcgcggcgatcgcggatgaggaagcagaaacagctggaggatctgaccgatgaagttagcagattgcaaagcg

SEQ ID NO: 2199 - DNA, 244 bp, Glycine max
gtgatttgatcagaaaggaatatgacatgaagtgcaaattcttacggaatctggaatcaaaaggagaaaagacttctagaattgataaaatgcgtactgtagtcaaggatctgcattcaagaattagaattgcaattcttaggatagactctatatctaagaggattgaggaattgcgggacaaagagcttacgcctcaacttgaggagttgattgacgggttaagtcggatgtgggaagtgat

SEQ ID NO: 2200 - DNA, 250 bp, Glycine max
caaaatcgtgaggctgccaggaaaagccgactgaggaaaaaggcatatgtgcaacaattagagagcagtaggttgaaactgacccaacttgagcaggagctccagcgagcacgccagcagggaatatttatttcaagtactggagatcaggcacagtcaatgagtggaaatggcgctatggcatttgatgtagagtacgcacgatggttagaagagcataatagacaaaccaatgagctaagggctgcaa

SEQ ID NO: 2201 - DNA, 266 bp, Glycine max
  unsure (1)..(266): unsure at all n locations
gatcancaagaacctcaaccaggatgagtttgaggcactgctccaggagttcaagactgactacaaccagacacactttgtgaggaacaaggagttcaaggaagctgctgacaaacttgaggggccactcaggcagatctttgtggagttccttgagaggtcctgcactgctgaattctctggcttccttctctacaaagagcttggaaggaggctcaagaaaaccaaccccgtggtggcagagattttctctctgatgtctaggg

SEQ ID NO: 2202 - DNA, 249 bp, Glycine max
cttcaaccaggatgagtttgaggcactgctccacgtgttcaagactgactacaaccagacacactttgtcaggaacaatgagatcaaggaagccgctgacaaacttgagggtcccctcagacagatctttgtggattccttgagaggtcctgtactgctgaattctctggcttccttctctacaaagagcttggaaggaggctaaagaaaaccaaccctgtggtggctgagattttctcactgatgtct

SEQ ID NO: 2203 - DNA, 253 bp, Glycine max
cacaaagccagcaagcagcaagaagggcaatatcaaggagaccctcttgactccaagattctacaccactgactttgatgagatggagacactcttcaacactgagatcaacaaaaacctcaaccaggatgagtttgaggcactgctccaggagttcaagactgactacaaccagacacactttgtcaggaacaaggagttcaaggaagccgctgacaaacttgagggtcccctcagacagatctttgtggag

SEQ ID NO: 2204 - DNA, 259 bp, Glycine max
cagcaagaagggcaatatcaaggagaccctcttgactccaagattctacaccactgactttgatgagatggagacactcttcaacactgagatcaacaaaaacctcaaccaggatgagtttgaggcactgctccaggagttcaagactgactacaaccagacacactttgtcaggaacaaggagttcaaggaagccgctgacaaacttgagggtcccctcagacagatctttgtggagttccttgagaggtcctgcact

SEQ ID NO: 2205 - DNA, 211 bp, Glycine max
tacggctgcgagaagacgacagaaggggggcaatatcaaggagaccctcttgactccaagattctacaccactgactttgatgagatggagacactcttcaacactgagatcaacaaaaacctcaaccaggatgagtttgaggcactgctccaggagttcaagactgactacaaccagacacactttgtcaggaacaggagttcaaggaag

SEQ ID NO: 2206 - DNA, 271 bp, Glycine max
atcgagcgattcggctcgagctgactttgatgagatggagaccctcttcaacactgatatcaacaagaacctcaaacaggatgagtttgaggcactgctccaggagttcaagactgactacaaccagacacactttgtgaggaacaaggagttcaaggaagctgctgacaaacttgaggggccactcaggcagatctttgtggagttccttgagaggtcctgcactgctgaattctctggcttccttctctacaaagagcttggaaggagg

SEQ ID NO: 2207 - DNA, 237 bp, Glycine max
gaaagaggaagagaatgatatcaaaccgcgaatctgcacgccgatctcgcatgaggaagcagaagcacttggacgatcttgtttcccaagtggctcagctcagaaaagagaaccaacaaatactcacaagcgtcaacatcaccacgcaacagtacttatacgttgaggctgagaactcggtgcttagggctcaggtgggtgagttgagtcacaggttggagtctctgaacgagatcg

SEQ ID NO: 2208 - DNA, 235 bp, Glycine max
aaaagatggcttcctcaagtggaacatcttcagggtcatctctgcttcagaactctggttctgaggaggatttgcaggcggtgatggatcagagaaagaggaagagaatgatatcaaaccgcgaatctgcacggcgatctcgcatgaggaagcagaagcacttggacgatcttgtttcccaagtggctcagctcagaaaagagaaccaacaaatatcagtcaagcgtcaacatca

SEQ ID NO: 2209 - DNA, 264 bp, Glycine max
cagaactctggttctgaggaagatttgcaggcgatgatggaagatcagagaaagaggaagagaatgatatcaaaccgcgaatctgcacgccgatctcgcatgaggaagcagaagcacttggacgatcttgtttcccaagtggctcagctcagaaaagagaaccaacaaatactcacaagcgtcaacatcaccacgcaacagtacttaagcgttgaggctgagaactcggtgcttagggctcaggtgggtgagttgagtcacagg

SEQ ID NO: 2210 - DNA, 137 bp, Glycine max
aagaggaagagaatgatatcaaaccgcgaatctgcacgccgatctcgcatgaggcagcagaagcacttggacgatcttgtttcccaagtggctcagctcagaaaagagaaccaacaaatactcacaagcgtcaacat

SEQ ID NO: 2211 - DNA, 273 bp, Glycine max
gtctgggtcctggtcctgcctattgtgtcaattaaattgagaagggttgtattgtattgaatcatatatcgtatcatataaacatggcttgttcaagtggaacatcttcagggtcattatctctgcttcagaactctggttctgaggagatttgcaggcgatgatggaagatcagagaaagaggaagagaatgatatcaaaccgcgaatctgcacgccgatctcgcatgaggaagcagaagcacttggacgatcttgtttcccaagtggctca

SEQ ID NO: 2212 - DNA, 260 bp, Glycine max
gtttcccaagtggctcagctcagaaaagagaaccaacaaatactcacaagcgtcaacatcaccacgcaacagtacttaagcgttgaggctgagaactcggtgcttagggctcaggtgggtgagttgagtcacaggttggagtctctgaacgagatcgttgacgtgttgaatgccaccaccactgtggcgggttttggagcagcagcatcgagcaccttcgttgagccaatgaataataataataatagcttcttcaactt

SEQ ID NO: 2213 - DNA, 184 bp, Glycine max
ctcgagccgaatcggctcgagcatcttcagggtcattatctctgagtcagaactctggttctgaggaagatttgcaggcgatgatggaagatcagagaaagaggaagagaatgatatcaaaccgcgaatctgcacgccgatctcgcatgaggaagcagaagcacttggacgatcttgtttccca

SEQ ID NO: 2214 - DNA, 343 bp, Glycine max
  unsure (1)..(343): unsure at all n locations
gagaaaaaggaaaagaatgatatcaaaccgcaaatctgcacggcaatctcgcatgaggaagcagaagcacttggacgatcttgtttcccaagtggctcagctcagaaaagagaaccaacaaatactcacaagcgtcagcatcancacgcaacagtacctgagcgttgaggctgagaactcggtgcttaaggctcaagtgggtgaacttaatcacaagttaaagtctctgaatgagatcgttgacgtgttgaatgccaccactgtggcgggttttggagcagcagcaacatcgagcaccttcgttgagccaattaataataatagcttcttcaacccgttgaat

SEQ ID NO: 2215 - DNA, 269 bp, Glycine max
  unsure (1)..(269): unsure at all n locations
atcnatgcgcatggntaggtctggttatgagagagagtgtcttcaggtttatagtagcgtccgncgtgacgctttggatgagtgtttgattattctcggtgttgagaggtttagtattgaagaggttcagaangttgagtggaggagtttngattanaagatgaagaattgggttcaggctgttaaggttgtgttggagtgcttctcagtggtgagaagangctgtgtgatggcttgttggggatttggatgatctgnanganatttgc

SEQ ID NO: 2216 - DNA, 343 bp, Glycine max
  unsure (1)..(343): unsure at all n locations
cctctttcttcctcgcctagctagctccagaaaattaggatctgcttcagatctagtgtttccctgtcccaaatcacgagtccattgagtttgattttgtggatgaaaagcatagatagggcttttgcaaaactctccaatgtttcttgaaattatatgaccatgcgtcgaattcgtatgctgcactccttctccgtcgtgttcctctactggttctacgttttctcatgaactccctcttaaatccgtgattaattagatctatctccttagttaatccttgtcttttcccataattnattagatctgcgtctccttttgganncggntctttgtgggtctg

SEQ ID NO: 2217 - DNA, 248 bp, Glycine max
ctcgcctagctagctccagaaaattaggatctgcttcagatctagtgtttccctgtcccaaatcacgagtccattgagtttgattttgtggatgaaaagcatagatagggcttttgcaaaactctccaatgttcttgaaattatatgaccatgcgtcgaattcgtatgctgcactccttctccgtcgtgttcctctactggttctacgttttctcatgaactccctcttaaatccgtgattaattaga

SEQ ID NO: 2218 - DNA, 261 bp, Glycine max
cattcggctcgagatctcggttgctcgcctagctagctccagaaaattaggatctgcttcagatctagtgtttccctgtcccaaatcacgagtccattgagtttgattttgtggatgaaaagcatagatagggcttttgcaaaactctccaatgtttcttgaaattatatgaccatgcgtcgaattataatgctgcactccttctccgtcgtgttcctctactggttctacgttttctcatgaactccctcttaaatccgt

SEQ ID NO: 2219 - DNA, 250 bp, Glycine max
ctctttcttcctcgcctagctagctatagaaaattaggatctgcttcagatctagtgtttccctgtcccaaatcacgagtccattgagtttgattttgtggatgaaaagcatagatagggcttttgcaaaactctccaatgtttcttgaaattatatgaccatgcgtcgaattcgtatgctgcactccttctccgtcgtgttcctctactggttctacgtattccattgaactccctcttaaatccgtga

SEQ ID NO: 2220 - DNA, 240 bp, Glycine max
cctcgcctagctagctccagaaaattaggatctgcttcagatctagtgtttccctgtcccaaatcacgagtccattgagtttgattttgtggatgaaaagcatagatagggcttttgcaaaactctccaatgtttcttgaaattatatgaccatgcgtcgaattcgtatgctgcactccttctccgtcgtgttcctctactggttctacgttttctcatgaactccctcttaaatccgtg

SEQ ID NO: 2221 - DNA, 242 bp, Glycine max
ctttaatccctcgcctatatcttcagaaaattagatctgcttcagatctagggtttcccttttccaaatcacgagtccgttgagtttgattttgtggatgaaagcatagggatagggcttttgcaaacctctccaatgtttctcgaaattatatgaccatgcgtcgaattcgtatgctgcactccttctccgtcgtgttcctctactggttctacgttttctcatgaactccctctcaaatc

SEQ ID NO: 2222 - DNA, 254 bp, Glycine max
gctagctccagaaaattaggatctgcttcagatctagtgtttccctgtcccaaatcacgagtccattgagtttgattttgtggatgaaaagcatagatagggcttttgcaaaactctccaatgtttcttgaaattatatgaccatgcgtcgaattcgtatgctgcactccttctccgtcgtgttcctctactggttctacgttttctcatgaactccctcttaaatccgtgattaattagatctatctccttag

SEQ ID NO: 2223 - DNA, 238 bp, Glycine max
ggacattgagggagagacatctatgaatgacaacacggaccctgctgatgtaaaacgagtaaggaggatgctatccaatagggagtcagcccgacgctctaaagaagaaagcaggctcatttaactgacctagaaacacaggtttctcaattaagaggtgaaaattctaccttgttaaagcgccttactgatgttagtcagaaatacagcgactctgctgttgacaacagagttttaa

SEQ ID NO: 2224 - DNA, 257 bp, Glycine max
ggacattgagggagagacatctatgaatgacaacacggaccctgctgatgtaaaacgagtaaggaggatgctatccaatagggagtcagcccgacgctctgaagaagaaagcaggctcatttaactgacctagaaacacaggtttctcaattaagaggtgaaaattctaccttgttaaagcgccttactgatgttagtcagaaatacagcgactctgctgttgacaacagagttttaaaagctgacgttgaaacatt

SEQ ID NO: 2225 - DNA, 269 bp, Glycine max
tacggctgcgagaagacgacagaaggggaagcggatggagtcgaaccgcgagtccgcacggcgatcgcggatgaagaagcagaagctgctcgaagacctatccgacgtagcgagtcgccttcaaggcgagaacgtgcgcttagcgcagagcataaaggcgaaggaggaagcgtacgttgagatcgaagccgcgaacgacatcctcagagcacagaccatggaactcgccgaccggttaaggtttctgaactccattctcgagatcgccg

SEQ ID NO: 2226 - DNA, 275 bp, Glycine max
tacggctgcgagaagacgacagaaggggaagcggatggagtcgaaccgcgagtccgcacggcgatcgcggatgaagaagcagaagctgctcgaagacctatccgacgtagcgagtcgccttcaaggcgagaacgtgcgcttagcgcagagcataaaggcgaaggaggaagcgtacgttgagatcgaagccgcgaacgacatcctcagagcacagaccatggaactcgccgaccggttaaggtttctgaactccattctcgagatcgccgatgagg

SEQ ID NO: 2227 - DNA, 374 bp, Glycine max
agtacggctgcgagaagacgacagaagggggaagcggatggagtcgaaccgcgagtccgcacggcgatcgcggatgaagaagcagaagctgctcgaagacctatccgacgtagcgagtcgccttcaaggcgagaacgtgcgcttagcgcagagcataaaggcgaaggaggaagcgtacgttgagatcgaagccgcgaacgacatcctcagagcatagaccatggaactcgccgaccggttaaggtttctgaactccattctcgagatcgccgatgaggtcggcggcggtggtgaatccttcgagattccgcagattccagaccctctcttcatgccctggcagattccccaccctatgatggcgtcacctgaca

SEQ ID NO: 2228 - DNA, 254 bp, Glycine max
agcgagcgccgtctctgcgaccgcgtcttcttcggattcgcctccgccgcggactgctctgtcatggacgtctgccgcggatcggcgattcagctgctgactttcgccgacgccgtctcgatcgggagccggttctcggaaaggctgttccgaatcctcgacgtgttcgagacgctgcgtgacctatttccggagttcgaggctctgtttgctgatcagtttagtgtgtcgctcaggaatgaagcgattacgat

SEQ ID NO: 2229 - DNA, 269 bp, Glycine max
attaaagcctccaacgtcgctctcaagatcctcttccccagcgagctccgtctctgcgaccgcgtcttcttcggattcgcctccgccgcggacttctctttcatggaggtctgccgcggatcggcgattcagctgctgaatttcgccgacgccgtcgcgatcgggagccggtcgccggaaaggctgttccgaatcctcgacgtgttcgagacgctgcgtgacctatttccggattcgaggctctgttttctgatcactttagtgtgtcg

SEQ ID NO: 2230 - DNA, 275 bp, Glycine max
cgggatgccaagctacgctcctccattgccttcttctaattccatagccatggaagcaactaatgttcatccttcccgcatttctgaatttggaaccctggagcaatctcttggatttcgcgttgaagataccattaatcttagcagaaatccgatgtttaatcaaatgaaatcaaatagccaagctctaggtgctgatattcaatttggtgctttaaataagtcaattgcaacatcagatatagacctctctgctgctattgctgggtctcaag

SEQ ID NO: 2231 - DNA, 242 bp, Glycine max
cgaatattaacgaccaggcaatcagctcgagctcttctcgccatcagtgattatttctcacggctgcgagctctgagttctttgaagcttgctaggccaagggagtgaagcatttcacagcccattagtggacttctttcatacctgacccccttaaagactgatcgttgaatcttgtgctctgaatgagttcaatggaagctggtgtcttttgacaatgaattcctctagaagcctagttg

SEQ ID NO: 2232 - DNA, 277 bp, Glycine max
tgacaatctgcggcagagacattacaacaaatgcttcgaatattaacgaccaggcaatcagctcgagctcttctcgccatcagtgattatttctcacggctgcgagctctgagttctttgtggcttgctaggccaagggagtgaagcatttcacagctccattagtggacttctttcatacctgacccccttaaagactgatcgttgaatcttgtgctctgaatgagttcaatggaagctggtgtcttttgacaatgaattcctctagaagcctagt

SEQ ID NO: 2233 - DNA, 258 bp, Glycine max
atcccacttggacttccacctcacccctttttatcaacgccatgaaaatagatatcagcaattgatcaaaggtcattttgttattgtggctctgagaggggagtgattctaaactaaaataaatgggggctggggaagagagtacagctaaatcttctaaagtatcttcggcagctacggagacaccaacagcacttgcatatcctgactggtcaagctccatgcaggcctattatgctcctggaggcactccacctc

SEQ ID NO: 2234 - DNA, 146 bp, Glycine max
ttccacctcacccctttttctcaacgccatgaaaatagatatcagcaattgatcaaaggtcattttgtttttgtggctctgagaggggagtgattctaaactaaaatatatgggggctggggaagagagtacagctaaatcttcta

SEQ ID NO: 2235 - DNA, 154 bp, Glycine max
ctttgtcccatcccacttggacttccacctcacccctttttctcaacgccatgaaaatagatatcagcaattgatcaaaggtctttttgtttttgtggctctgagaggggagtgattctaaactaatatatatgggggctggggaagagagcac

SEQ ID NO: 2236 - DNA, 239 bp, Glycine max
aaccactttgtcccatcccacttggacttccacctcacccctttttttcaacgccatgaaaatagatatcagcaattgatcaaaggtcattttgtttttgtggctctgagaggggagtgattctaaactaaaatatatgggggctggggaagagagtacagctaaatcttctaaagtatcttcggcagctcaggagacaccaacagcacttgcatatcctgactggtcaagctccatgc

SEQ ID NO: 2237 - DNA, 288 bp, Glycine max
cccacgcgtccgcttttgttccccacagcagattcagcaaggccattttcaatgcttggccttggtgatattgttatccctggtatttttgtagcattggctttgcgatttgatgtatctagaggaaaacagccccagtatttcaagagtgcatttgtaggatacactgttggcttggtccttacaattgttgtgatgaactggtttcaggctgcacagcctggtcttttggatattgtaccttctggaattggatttttggctgctcattggttatggaatggtgat

SEQ ID NO: 2238 - DNA, 266 bp, Glycine max
ggcattcggctcgacagacaattggatactggagatacataaccatatacagacatctcaaggccaaccccgagttccaatgtcatcccatttcccagtactttgagaactggtgccaggctgagaacaggcatggagatttcttctctgccctgatgaaggcacagccacaatttctaaatgactggacggcaaagttgtggtctcgattcttctgtctatcggtttatgttacaatgtatctcaatgattgccaacgtacagct

SEQ ID NO: 2239 - DNA, 245 bp, Glycine max
ttccaatgttatcccatttttaagtactttgagaactggtgccaggatgagaacaggcatggagatttcttctctgccctgatgaaggcacagccacaatttctaaatgactggaaggcaaagttgtggtctcgattcttccgtctatcggtttatgttacaatgtatctcaatgattgccaacgtacagctttctatgaaggcattggacttaacacaaaagaatttgacatgcatgtcatcat

SEQ ID NO: 2240 - DNA, 185 bp, Glycine max
gtaaattgggtactggagatacataaccatatacagacatctcaaggccaaccctgagtttcaatgttatcccatttttaagtactttgagaactggtgccaggatgagaacagacatggagatttcttctctgccctgatgaaggcacagccacaatttctaaatgactggaaggcaaagttgt

SEQ ID NO: 2241 - DNA, 252 bp, Glycine max
gtttatctgatttcaatttggctctggacttgggtttcttgaccaaagctagaaaatacacatttttcaagccaaagtttatcttctatgctacatacttgtctgagaaaattgggtactggagatacataaccatatacagacatctcaaggccaaccctgagtttcaatgttatcccatttttaagtactttgagaactggtgccaggatgagaacagacatggagatttcttctctgccctgatgaagg

SEQ ID NO: 2242 - DNA, 267 bp, Glycine max
  unsure (1)..(267): unsure at all n locations
gagaanattgggtactggagatacataaccatatacagacatctcaaggccaacccngagtttcaatgttatcccatttttaagtactttgagaactggtgccaggatgagaacagacatggagntttcttctctgccctgntgnnggcacagccacnaatttctaaatgactggaangcaaagttgtggtctcgattcttctgtcntatncggtttatgtcnacaatgtntctcatgattgccaacgtacagctttctacgaaggc

SEQ ID NO: 2243 - DNA, 251 bp, Glycine max
cgaggagaagtccaagttatacaaagaagtctccttgcagcacttgttcttaatgaacaacctgcattatatggctgaaaaggttaaggggtctgaactcaggctcatacatggagatgaatggattcgaaagtgcaattggaagtttcagcagcatgcaatgaaatatgagagagctagttggagtcccattctcaacttgcttaaggatgagggaattcatgttccgggtacaaattcggtctcaaaaa

SEQ ID NO: 2244 - DNA, 434 bp, Glycine max
cccgggctcgaccaacgcgtcaggggtgttgtcagtagatgagatatcggagcaatactgggtggctgcatcatcttcttcatcatcatcatcatcatcgttcaagtcaaagatgaaccggagcgaatccgaatgggcctttcagcagttcctacagcaggaagctgcttcttcttcatctaattctgatcatgatgatgatcatcatcatgctaaactcaaaaaggaatccaacaccaacatccctgttactctacatgttgattcccaagactaccatgctattcttaagaccaagcttaatctcgcatgcgctgctgttgctatgactcggggatctttggtcaaatctcaaaaccctgacagtggaccacaggcatctaatttttctgaagttggatcgcatgctaccttaaaaggatctggcccttttg

SEQ ID NO: 2245 - DNA, 248 bp, Glycine max
actcgagccgattcggctcgagctcaaatctgaggtacagaaatagaatttgagcttcttagattggattcacgcccagacgtcccatgtgaaagccttgaatggttggctggtaagatgtctattatacgaacccgaagaagtacccgatgattcaactcccttctcacctagcaagattggggcaccacctgtgtttgtgatctgtcacaaatggtcaagggcagtggataatctctcagagaaga

SEQ ID NO: 2246 - DNA, 207 bp, Glycine max
gaaaaatgtccgaaaacggagaagagaaattactcgctgtggcgcggcacatagccaaaacgctgggccacaacaacaccatgtctgatgacatattccaaatactatcgaacttcgatggaagattctcgagagagaatctttctgagaagggcgcagatgtggatcccagaggctgcgccgcactggatcattccctcaaatccc

SEQ ID NO: 2247 - DNA, 135 bp, Glycine max
aaatgtccgaaaacggagaagagaaattactcgctgtggcgcggcacatagccaaaacgctgggccacaacaacaccatgtctgatgacatattccaaatactatcgaacttcgatggaagattcttcgagagag

SEQ ID NO: 2248 - DNA, 275 bp, Glycine max
actaaactaaactagcgaagagaaatgtccgaaaacggagaagagagattactcgctgtggcgcggcacatagcgaaaacgctgggccacaacaacaccatgtctgatgacatattccaaatactatcgaacttcgacggaagattctcgagagagaatctttctgagaaaggcgcagatgcggatcccagaggctgcgccgcactggatcattccctcaaaaccctagaccgccggatctctctctacgtctcctacgaccgccctatctggtc

SEQ ID NO: 2249 - DNA, 111 bp, Glycine max
gtaaaatgtccgaaaacggagaagagaaattactcgctgtggcgcggcacatagccaaaacgctgggccacaacaacaccatgtctgatgacatattccaaatactatcga

SEQ ID NO: 2250 - DNA, 173 bp, Glycine max
gaaaaatgtccgaaaacggagaagagaaattactcgctgtggcgcggcacatagccaaaacgctgggccacaacaacaccatgtctgatgacatattccaaatactatcgaacttcgatggaagattctcgagagagaatctttctgagaagggcgcagatgtggatcccaga

SEQ ID NO: 2251 - DNA, 277 bp, Glycine max
gcgctgaaaaatgtccgaaaacggagaagagaaattactcgctgtggcgcggcacatagccaaaacgctgggccacaacaacaccatgtctgatgacatattccaaatactatcgaactacgatggaagattctcgagagagaatctttctgagaagggcgcagatgtggatcccagaggctgcgccgcactggatcattccctcaaatccctagaccgccggatctctccctacgtctcctccgaccgcacaatctgggccgacgccgccgattct

SEQ ID NO: 2252 - DNA, 268 bp, Glycine max
cggcagatgtggatcccagaggctgcgccgcactggatcattccctcaaatccctagaccgccggatctctccctacgtctcctccgaccgcacaatctgggccgacgccgccgattctgctgccttcctcgacgccgtggacgagctcgtcgccgtcgtcgccgagtggaaccacctcgcctccgacaagtccgtcgccgcctgcctcgtccgcgccgaggacatgctccagcacgccatgttccgcctcgaggacgagttccgctc

SEQ ID NO: 2253 - DNA, 386 bp, Glycine max
ggagaagagaaattactcgctgtggcgcggcacatagccaaaacgctgggccacaacaacaccatgtctgatgacatattccaaatactatcgaacttcgatggaagattctcgagagagaatctttctgagaagggcgcagatgtggatcccagaggctgcgccgcactggatcattccctcaaatccctagaccgccggatctctccctacgtctcctccgaccgcacaatctgggccgacgccgccgattctgctgccttcctcgacgccgtggacgagctcgtcgccgtcgtcgccgagtggaaccacctcgcctccgacaagtccgtcgccgcctgcctcgtccgcgccgaggacatgctccagcacgccatgttccgcct

SEQ ID NO: 2254 - DNA, 338 bp, Glycine max
agtacggctgcgagaaacgacagaagggggaagcaaactaacttgagctgagaaatgtccgaaaacggagaagagaaattactcgctgtggcgcggcacatagccaaaacgctgggccacaacaacaccatgtctgatgacatattccaaatactatcgaacttcgatggaagattctcgagagagaatctttctgagaagggcgcagatgtggatcccagaggctgcgccgcactggatcattccctcaaatccctagaccgccggatctctccctacgtctcctccgaccgcacaatctgggccgacgccgccgattctgctgccttcctcgacgc

SEQ ID NO: 2255 - DNA, 281 bp, Glycine max
cctttttcaccttccccctttgtttctcaacatcattctcctcattcccctacctacacccaattttcccttctgtatttctctttttcaattctcgatttcccttctcccttttgtgtcttcataatccagatcctctcttcgatctagggtttctggcttaattaacaatcaaatgtttaaggaagaatttctatgacgattcgcaaccccatgcgacgaatccgtctcctccactccttctccgtcgtcttcctctactggttctacgttttctcatg

SEQ ID NO: 2256 - DNA, 165 bp, Glycine max
agaaaccctagatcgaagagaggatctggcttaattaacaatcaaatgtttaaggaagaatttctatgacgattcgcaaccccatgcgacgaatccgtctcctccactccttctccgtcgtcttcctctactggttctacgttttctcatgaactaacccctctc

SEQ ID NO: 2257 - DNA, 263 bp, Glycine max
gttcctggcttaacgaaatcaaatgtttaaggaagaatttctatgacgattcgcaaccccatgcgacgaatccgtctcctccactccttttccgtcgtcttcctctactggttctacgtcttctcatgaactaaccccctctcaatcccctaatttctccaacatttccccctttttctaattaatcagatctgcaaaaccctaatttccctaaccctaacgaaacccccaaatccaatggcttcgattcaacgcccggcgag

SEQ ID NO: 2258 - DNA, 266 bp, Glycine max
gcttaacgaaatcaaatgtttaaggaagaatttctatgacgattcgcaaccccatgcgacgaatccgtctcctccactccttttccgtcgtcttcctctactggttctacgtcttctcatgaactaaccccctctcaatcccctaatttctccaacatttccccctttttctaattaatcagatctgcaaaaccctaatttccctaaccctaacgaaacccccaaatccaatggcttcgattcaacgccccggcgagttcgggatc

SEQ ID NO: 2259 - DNA, 288 bp, Glycine max
caccttcccctttgtttctcaacatcattccccaatttccccttctgtattgtttttcttcatttctctttttcaatccccgatttcccccttcttcgttttgtgtcttcataattcagatcctctcttcaatctagggttcctggcttaacgaaatcaaatgtttaaggaagaatttctatgacgattcgcaaccccatgcgacgaatccgtctcctccactccttttccgtcgtcttcctctactggttctacgtcttctcatgaactaaccccctctcaatcccc

SEQ ID NO: 2260 - DNA, 255 bp, Glycine max
ccgcgtccggcgagttcgggatcttcggagggaggaggagatccggctgcgatggacgagagaaagaggaagcggatggagtcgaaccgcgagtccgcacggcgatcgcggatgaagaagcagaagctgctcgaagacctatccgacgtagcgagtcgccttcaaggcgagaacgtgcgcttagcgcagagcataaaggcgaaggaggaagcgtacgttgagatcgaagccgcgaacgacatcctcagagcacag

SEQ ID NO: 2261 - DNA, 341 bp, Glycine max
aacctttttcaccttccccctttgtttctcaacatcattctcctcattcccctacctacccccaattttcccttctgtatttctctttttcaattctcgatttcccttctcccttttgtgtcttcataatccagatcctctcttcgatctagggtttctggcttaattaacaatcaaatgtttaaggaataatttctatgacgattcgcaaccccatgcgacgaatccgtctcctccactccttctccgtcgtcttcctctactggttctacgttttctcatgaactaactccctctcaatcccctaccctaattcctccaatttccccatttggtttcta

SEQ ID NO: 2262 - DNA, 277 bp, Glycine max
cctttttcaccttccccctttgtttctcaacatcattctcctcattcccctacctacccccaattttcccttctgtatttctctttttcaattctcgatttcccttctcccttttgtgtcttcataatccagatcctctcttcgatctagggtttctggcttaattaacaatcaaatgtttaaggaagaatttctatgacgattcgcaaccccatgcgacgaatccgtctcctccactccttctccgtcgtcttcctctactggttctacgtcttct

SEQ ID NO: 2263 - DNA, 254 bp, Glycine max
aatttctctatcctaacaaaaaccccaaattcaaacaaatccaatggcttcgattccgcgtccggcgagttcgggatcttcggagggaggaggagatccggctgcgatggacgagagaaagaggaagcggatggagtcgaaccgcgagtccgcacggcgatcgcggatgaagaagcagaagctgctcgaagacctatccgacgtagcgagtcgccttcaaggcgagaacgtgcgcttagcgcagagcataaagg

SEQ ID NO: 2264 - DNA, 246 bp, Glycine max
ggcttaattaacaatcaaatgtttaatgaagaatttctatgacgattcgcaaccccatgcgacgaatccgtctcctccactccttctccgtcgtcttcctctactggttctacgttttctcatgaactaactccctctcaatcccctaccctaattcctccaatttccccattttttttctaattaatcagatttgcaaaatcctaatttctctatcctagcaagaaccccagattcatacatatc

SEQ ID NO: 2265 - DNA, 265 bp, Glycine max
ctggttctacgttttctcatgaactaactccctctcaatcccctaccctaattcctccaatttccccattttttttctaattaatcagatttgcaaaatcctaatttctctatcctaacaaaaaccccaaattcaaacaaatccaatggcttcgattccgcgtccggcgagttcgggatcttcggagggaggaggagatccggctgcgatggacgagagaaagaggaagcggatggagtcgaaccgcgagtccgcacggcgatcg

SEQ ID NO: 2266 - DNA, 258 bp, Glycine max
gaactaactccctctcaatcccctaccctaattcctccaatttccccattttttttctaattaatcagatttgcaaaatcctaatttctctatcctaacaaaaaccccaaattcaaacaaatccaatggcttcgattccgcgtccggcgagttcgtgatcttcggagggaggaggagatccggctgcgatggacgagagaaagaggaagcggatggagtcgaaccgcgagtccgcacggcgatcgcggatgaagaagc

SEQ ID NO: 2267 - DNA, 289 bp, Glycine max
ctctactggttctacgttttctcatgaactaactccctctcaatcccctaccctaattcctccaatttccccattttttttctaattaatcagatttgcaaaatcctaatttctctattctaacaaaaaccccaaattcaaacaaatccaatggcttcgattccgcgtccggcgagttcgggatcttcggagggaggaggagatccggctgcgatggacgagagaacgaggaagcggatggagtcgaaccgcgagtccgcacggcgatcgcggatgaagaagcagaagc

SEQ ID NO: 2268 - DNA, 267 bp, Glycine max
  unsure (1)..(267): unsure at all n locations
tagatttgcaaatcctaatttctctatcctaacaaaaaccccaaattcaaacaaatccaatggcttcgattccgcgtccggcgagttcgggatcttcggaggttngattagatccggctgcgatggacgagagaaagaggaagcggatggagtcgaaccgcgagtccgcacggcgatcgcggatgaagaagcagaagctgctcgaagacctatccgacgtagcgagtcgccttcaaggcgagaacgtgcgcttagcgcagagcataa

SEQ ID NO: 2269 - DNA, 410 bp, Glycine max
  unsure (1)..(410): unsure at all n locations
aagaatttctatgacgattcgcaaccccatgcgacgaatccgtctcctccactccttctccgtcgtcttcctctactggttctacgtcttctcatgaactaactccctctcaatcccctaccctaattcctccaatttccccattttttttctaattaatcagatttgcaaaatcctaatttctctatcctaacaaaacccccaaattcaaacaaatccaatggcttcgattccgcgtccggcgagttcgggatcttcggagggaggaggagatccggctgcgatggacgagagaaagaggaagcggatggagtcgaaccgcgagtccgcacggcgatcgcggatgaagaagcagaagctgctcgaagacctatccgacgtancgagtcgccttccaggcgagaacgtgc

SEQ ID NO: 2270 - DNA, 548 bp, Glycine max
  unsure (1)..(548): unsure at all n locations
ngaggggaggaggcgtcttcgtatagccggagagaggggagatgtatcgactcgctatgacgtcgcattgccccctacctaagcttcggattccggttcagggttaaccctttttaaccttcccctttggttcttaaccataatcttggtaagtcccttacctacccccaattttcctttcggaattcctctttttcaattctcgatttcctttcttcctttggggtcttcataatccagatcctctcttcgatctagggtttctggcttaattaacaatcaaatgtttaagggaagaatttctatgacgattcgcaaccccatgcgacgaatccgtctcctccactccttctccgtcgtcttcctctactggttctacgttttctcatgaactaactccctctcaatcccctaccctaattcctccaatttccccattttttttctaattaatcagatttgcaaaatcctaatttctctatcctaacaaaaaccccaaattcaaacaaatccaatggcttcgattccgcgtccggcgagttcgggat

SEQ ID NO: 2271 - DNA, 416 bp, Glycine max
atacggctgcgagaagacgacagaagggaatcaaatgtttaaggaagaatttctatgacgattcgcaaccccatgcgacgaatccgtctcctccactccttctccgtcgtcttcctctactggttctacgttttctcatgaactaactccctctcattcccctaccctaattcctccaatttccccattttttttctaattaatcagatttgcaaaatcctaatttctctatcctaacataaaccccaaattcaaacaaatccaatggcttcgattccgcgtccggcgagttcgggatcttcggagggaggaggagatccggctgcgatggacgagagacagaggaagcggatggagtcgaacgcgagtccgcacgcgatcgcggttgagaaacagaagctgctcgaagacctatc

SEQ ID NO: 2272 - DNA, 205 bp, Glycine max
aatttttgttcgtactacatgttatgcagtcatgaatgattgagagacaacacaaatgtcttccccagtgatcagcgagatcctcctctctgggcttcaccataaactcttccctaagacgcaggacacacttggtgcaatctttctcagttgttttcctccactggttctacgttttctcatgaactaaattaactgacctcgt

SEQ ID NO: 2273 - DNA, 256 bp, Glycine max
caaacccaagccttgtacctctcaaagtttgattcttttctcttgcccaaagcgatttggattgctataatttttgttcgtactacatgttatgcagttcatgaatgattgagagacaacacaaatgtcttccccagtgatcagcgagatcctcctctctggcttcaccataaactcttccctaagacgcaggacacacttggtgcaatctttctcagttgttttcctccactggttctacgttttctcatgaact

SEQ ID NO: 2274 - DNA, 259 bp, Glycine max
aaatgtcttccccagtgatcagcgagatcctcctctctggcttcaccataaactcttccctaagacgcaggacacacttggtgcaatctttctcagttgttttcctccactggttctacgttttctcatgaactaaattaactgacctcgtacataggagtataaacatagtactcgtgttcttttttcaatactacatcacattcagatcattaaatctagctagcaaattagagttattatttattatcattgcaca

SEQ ID NO: 2275 - DNA, 185 bp, Glycine max
ggaaaaggaaagaggcatggggtgtgccagctccaagctggaagatctccccgcagtggccctgtgccgggagcggtgtggtttcctggacgaagcaattcaccagcgctatgcactcgccgccgctcacatcgcttacataaattctctcaagtcaattggtcactccttacccttttcattca

SEQ ID NO: 2276 - DNA, 260 bp, Glycine max
  unsure (1)..(260): unsure at all n locations
ctccgagagaganactcacgacttcatgaacgtcgactcgttctcccaactccccttcatccgcccggctcctcttgtcagagagaagtcaggcattcgcctctttggcatcgaatttgccggcggannnnnnnnnnnnnnnnnnnnnnntaacaattttgttgttgtctcggccgaggattctgagtcggccgaaataacaacagcagccaacaccaacaccaacatcaatancaacaaatcaacattcgacctcgatc

SEQ ID NO: 2277 - DNA, 165 bp, Glycine max
  unsure (1)..(165): unsure at all n locations
gttcctgctgtcacactattaaccttgtaccagtactagaatctaatcaagtcattcattgtacgaactgccggacaacactcatgtatccttatggagcttcctcagtaaaatgtgcaatttgtcgctatattactaatgtcagtatgcnganngnngggtccc

SEQ ID NO: 2278 - DNA, 289 bp, Glycine max
gcaaagctcaattgatgagggacgatccatttcctttcctccttctctatattgaccggcgcagtgatgccaagccatatagcatatatttcacaacaagaaaaagaaaaacctcagctgagtgaaatagtgaatggctatctctttttctgatactcttttggtaattgtttaattcatttgtaggtcaattgattgcaagcactttgactttggggaagggaactgcccttttggaactagttgtttctacaagcatgcatatcgagatggccgtctggagcaggta

SEQ ID NO: 2279 - DNA, 294 bp, Glycine max
  unsure (1)..(294): unsure at all n locations
tcagattggaaagcccacaccanaacctgtggcactagagaatacaaatgcgactgtngcaccctcttctccaggaaagacagcttcattactcatagagcattctgcgatgcattggctgaagagagtgctaggctcacatcagttacaacaacaaatctaaatttcaagagtgaagagggtggtaataatgtgatgaactcgcagcagcatggtttgggaggacatggactaattggagcncaaagtcttcaaaatgtttctggcattccacaatttggttcacanggtttt

SEQ ID NO: 2280 - DNA, 349 bp, Glycine max
  unsure (1)..(349): unsure at all n locations
gggtcaaagaatgggttccccaagatcttgtgacaacaggagggaagtgcatgatcttaaaatgggtaacagaggataccttgaagaccttgaaagaaaaggtaaaagagccttcagtgccagagccagaacctgagccaactactgaagtactttttctttgcagctatgatggctgtggaaagacattcatagatgctggtgcattgaggaaacattctcacatccatggagagaggcagtatgtttgtcactacgatggatgtggaaagaaatttctggatagctcaaagttgaaaagacatttctcatcatacangggagaggatttgtgtgtcctcagaagctg

SEQ ID NO: 2281 - DNA, 137 bp, Glycine max
tctcaaagttaagactggaaccgtgcctgtttgtcattttgttggcaacaaggctattgcttgggtacccaatctagtcactagtgaatcttgtgtggtctagttgctatatattttgttgtacactagttttcatt

SEQ ID NO: 2282 - DNA, 258 bp, Glycine max
  unsure (1)..(258): unsure at all n locations
gtacggtagctaatagtagtatttctgtgattggtgttgcagattgatcaagtgaatataatattggtaatgatggatctgaaggaatggtcatcatcttctgnggaattgaatgtgaacaggaaatgttgcgctgattgcaaaaccaccaagaccccactctggagaggaggaccagctggacccaagactctatgcaacgcttgtggaattaggtatcggaagagaagggcatgttggaggaagggagagttgaag

SEQ ID NO: 2283 - DNA, 259 bp, Glycine max
ttcggagatgcgcacgtggcaggtcacatgactggaccgagtgtccgtacgcccaccccggggagaaggctcgccgccgtgatccccggaagtaccattactccggcacggcgtgccccgatttccgcaaggggagttgcaagaagggtgacgcgtgcgagtacgcgcatggggttttcgagtgctggctccaccccgcacgttaccgtactcagccctgcaaggacggcaccagttgtcgccggcgcgtgtgtttctt

SEQ ID NO: 2284 - DNA, 260 bp, Glycine max
aacgttagcgcctccgaacataccaccaacaaagacgtcaacaacaacgtagaaaacggcgagagcagccgcagattcgagtgccattgttgttgcagaaacttccccacttcccaggccttaggcgggcaccaaaacgcgcacaaacgagagcgccacacgcgaaacgacaccttcaaagtaccctgatctccgatgcaaacgcgtatagcttcgtgaactacaggttcggttccacggcaatgtctaattacactgag

SEQ ID NO: 2285 - DNA, 268 bp, Glycine max
gtgaggatgaggttgagattaaatgcatgggacatccagtgcttccttcactgcaggtgcaaaacttggttgactcgtggcttgatatggcggcttcaggacatagaattccagcaaccattggatcctcggggaaagattttgtcatgatcctaacctatggtcggaaggtcctacacccttgattgtggttcccagttcttcccctttcacatttttattatagcatgaaaaatcgaaaaccttcccagaataattgcttcctcgt

SEQ ID NO: 2286 - DNA, 268 bp, Glycine max
ctctaccaatctttaagttcaaattgaagaacaatgaaaatggtgatgaccaggatgccaattcagctatagatgaaggtggaattttggctgcagggacagaaaaggagcgaatgatttcaggagaagatgctgtttgttgcatttgcttagcaaaatatgcagatgatgacgagcttagagagttaccttgctctcacgtttttcacgtcgaatgtgttgacaaatggttaaagataaatgcaacctgccctctctgtaaaaatga

SEQ ID NO: 2287 - DNA, 218 bp, Glycine max
cccaaacacaaacatcatagtatatagtatctatctaaagtaaataatcatggcacgggagaaccctcttgttattggtggtgtgattggggatgttctcaacccttttacaagctccgtttctttgactgtttcaatcaataatagggcgattagcaatggcttggaactcaggccctctcaagttgttaatcgccctagggttactgttggtggtg

SEQ ID NO: 2288 - DNA, 221 bp, Glycine max
ggatgcaagacccaacagcattccaaggagtgaagccaccccagtttcctgaacaagaacaactcaagtgtccacgttgtgactccaacaacaccaaattctgctactataacaactacaacctctcgcagccacgccacttttgcaagaactgcagaaggtactggactaaaggtggcgctttgagaaacatccctgttgggggtggaagcagaaagacc

SEQ ID NO: 2289 - DNA, 264 bp, Glycine max
aaaccaggttcaaaggcgacttctagatgagtccatcgccgacgaaccttctgcagcagtttcaaagccgtggattgaactttattgtggtgcagtctcttcccacgtttcagttcaagaaaaacgagagagaacaagacaagacattagtgtggagtgtgccatctgcctcggagagtttgaagaaggggagtggctgaaacgtcttccacactgcagccatagtttccatgtttcatgcattggtacgtggtttcagtcgca

SEQ ID NO: 2290 - DNA, 268 bp, Glycine max
gactggaccgactgccccttcgcccatccgggtgaaaaggcacgccgccgtgacccacggcggtatcactactcaggaacagtctgtcctgagtatccccgcggagggtgcagccgtggcgatgcatgcgaatacgcccatggcgtgttcgaatgctggctgcacccttccaggtacagaacggaggcctgtaaggatggcaggaactgcaagcgaaaggtgtgttttttcgcacacacccctcgcccagctgagaattttgccggta

SEQ ID NO: 2291 - DNA, 249 bp, Glycine max
ggctgattcacctattgaacatgctcttgctgaggaggatgcggaatgttgcatctgcctttcttcttatgatgatggggttgagctaagagaacttccttgcggtcaccattttcactgtgtctgtgtggataaatggctgtatattaatgctacatgccccctctgcaagtataacatcttaaaaagtagcaacctcagtcaagatgtagtgtagaagatcgatgtcaggaaagtttttggcgccca

SEQ ID NO: 2292 - DNA, 236 bp, Glycine max
gatcaaggctcctaagcaggcctctggggagcacaagaagaaaaagaagatcaaagtgactttcccatcaggtcaagagcggaatgcaccatcacaggcaattaggaaatgcttgcactgtgagataaccaagacaccacagtggagggcagggccaatggggccgaaaacactctgcaatgcttgtggcgtgcgctacaagtcaggccggcttttccccgaatatcgccctgcag

SEQ ID NO: 2293 - DNA, 256 bp, Glycine max
ctccaacttaagaataagtttagttgatgccctaacagggaaggttgttagtacaggacctgaatcgtcagctaaggtggaaattgtagtccttgagggtgattttgaagaggaaagtgaaacttggatgcctgaagagttcaagagcaatattgtgagagagagggaaggaaaaaagcctcttcttacaggagatgtaattttatatcttaaagatgggattggtatggtgggtgaaatttcaatacagataatt

SEQ ID NO: 2294 - DNA, 259 bp, Glycine max
aatgaaaccaaatgtcatacctgtgcatagaatttgcattgactgggcaccacaagtgtactttgttggtgaagttgttaagaatttgaaggcagaggtggcaaggggagcaaaacttaaatgcagtaaatgtaatctaaagggagctgctcttggttgctatgtcaaatcctgtagaagaacgtatcatgttccttgtgcaatggacatctcagattgccgttgggatcatgaggattttctcttgctctgtcctgtc

SEQ ID NO: 2295 - DNA, 232 bp, Glycine max
cttgatgatctgttttcagctgagagttcttctcctagatatgctgatccagcattggcttcagctgtattttctccaactcacaaatcagctgtcttcaatcaatttcagcaccagcaaagcatgttggcacccctgaatactaattttgcctctaaaaattttgagcatcctttattgcaggccttcttgggaatgtctccacgaaatgtggaacctatgtctccaatgg

SEQ ID NO: 2296 - DNA, 260 bp, Glycine max
gttttgcagggatcggagattgaagtcgaggactcaaactcaaaccctaacgctccttcctcagggaacagtccaagcagcaacaatgagcagaagaaaacctgcgccgattgcggcaccaccaagactcctctctggaggggtggtcctgcaggacccaagtctctgtgcaacgcgtgcgggatcagaagcaggaagaagaagagagcgatcttgggaataaacaaggggagcaacgaggacggaaggaaaggaaaggg

SEQ ID NO: 2297 - DNA, 234 bp, Glycine max
ggttaccggcgacggcggcgtgcggcggtgcagccactgtgcctcggagaagacgccgcagtggcgcgcgggaccgctgggaccgaagacgctgtgcaacgcgtgcggggttcggttcaagtcgggtcggctcgtacccgaataccgacccgcggcgagccccacgttcgtgctgactcagcattcgaactcgcaccgcaaggtcatggagctccgtcgccagaaggagctgct

SEQ ID NO: 2298 - DNA, 274 bp, Glycine max
cattcggctcgagtgttatcacctataaatactaatttgctgtctcctaagaatgttgagcatcctctttttcaggcttcttttggtgtctctccttctggaaggatgtcaccaagaagtgttgaaccaatctctccaatgagtgctcgtttatctgcatttgctcagcgagagatacagcaacaacagctgcgcagtgttagttcaagagaccttggtgccaacagtcctgcctcacttgttggctcccctgcaaacccttggtcaaagtggg

SEQ ID NO: 2299 - DNA, 249 bp, Glycine max
  unsure (1)..(249): unsure at all n locations
aatccaccgatgctgagtcagactcggagtttccgtctcgggaaccggacatcgatgacccttcagtaaaatcctcaaaccctagtcatgatgtggaacctngctcgaaatgcgtatgtgagtacgtccatgactggaccgagtgtccgtacgcccaccccggggagaaggctcgccgccgtgatccccggaagtaccattactccggcacggcgtgccccgatttccgcaaggggagttgcaagaagg

SEQ ID NO: 2300 - DNA, 242 bp, Glycine max
gccaaatgtgccggctcttcatttaccaggaagcaatcttcaatctagtcgattgatgtcttccctaagtgctcgagacattccaccagaagactatgaacatgatgtctgatcttgatggacagcagcagcaccatctgaatgacttgagcctgttacatacagcctcgccccggtgccagtactgtgagtagatcaggtcggaccaagacccaaactccatcaaatctggaagagatctt

SEQ ID NO: 2301 - DNA, 245 bp, Glycine max
tcgaaatgaaacatttaatttgcgtgcaatgcttttttgtaccattaatgattttccagcatatgggaacttgagcagttacagtgttaaaggccatcgtgcatgccccatctgtgaagaagacacaagttacatacaactgaaacatggaagaaaaacagtgtacactaggcatcgacgttttcttaaacctcatcatccttaccgacgattgaaaaaaacatttaatggaagtcaagagcatg

SEQ ID NO: 2302 - DNA, 264 bp, Glycine max
ccaccccgcgcgctaccgcactcagccttgcaaggatggcaccagttgtcgccgccgcgtgtgtttcttcgcgcacacgccggatcaacttagggttttgccacagcagagtccgcgcagtgctgattcctacgacgggtctcctttgaggcacgcgattgagtcgtcgtgtgcaaagtcgcatccgtttgtggcttctcccggttcggcctcgtcgccggtggagtctccgccgatgtcgccgatgactgtgagtgttaatga

SEQ ID NO: 2303 - DNA, 255 bp, Glycine max
ctcagccagaacaagctctaaagtgccccagatataactccaccaacactaaattctgctactacaacaattacagcctttcccagccaaggtacttctgcaagtcatgcaggagatattggaccaaaggaggacacttaggaatgtccctgtgggaggagggtgcaggaagaacaaaaggtcatcatcatcatcttcaacatcaaagagagttcaagatcaagcattcacaccaaatgttaaccctctcactgg

SEQ ID NO: 2304 - DNA, 251 bp, Glycine max
gtcgcggttggtgcagccgtggcgatgcgtgcgaatacgcccatgggtgttcgaatgctggctgcacccttccaggtacagaacggaggcctgtaaggatggcaggaactgcaagagacaggtgtgttttttcgcagacacccctcgccagctgagaattttgccggtaacaacatcttcaccctcttcaaatgacatgccatgcaagaagaaccttaacaagctcttaaaccatgcttcaaagtcaaaca

SEQ ID NO: 2305 - DNA, 259 bp, Glycine max
gatccagtgacaggaatctcttgcgacatatgcattaacaatctcctagctgttgtgaataccaagcttcttcgggattatgcacacatagatccaaggttgcgtcactggctttcattattaaacattgggctaagtcaagaagagtcaatgaaacttaccatgggaccttgtctagctatgcgtatgttttgatgtgcattcattttttacaaatgagaagacctgctatccttccatgcttgcaggagatggagac

SEQ ID NO: 2306 - DNA, 243 bp, Glycine max
tgtgaacagggtctgtggttctgatagggccacagctctacattgtgcggttgccgggggctctgaatcctcacttgagattgtcaagctcttgcttgatgctggggctgatgccgagtgccttgatgccagtggcaacaagccggtcaatctgattgctcctgcctttgattctttgtcaaagtcgcgaaggaaggccatggagatgttcctcaggggtggtggggaaagagacgatgaact

SEQ ID NO: 2307 - DNA, 237 bp, Glycine max
gaacggggaaacgggtcgggtcttgcccaaatgcaatcacagtttccatactgagtgcatcgatgtgtggtttcagtctcatgccacgtgtccgctttgcagggaaaccgtggaggctatgcccgagcgagaaacccgatccgaggtggctgttattgtgtgcgagaccgaaccggttcgagaagaggtgaaccggtctggaccggtgggtgcttcttcttctgctgctgctacttc

SEQ ID NO: 2308 - DNA, 259 bp, Glycine max
tgccatggagatgttcctcatgggtagtggcgaaagagacgctgaactcatgagccaggagattcatgagagaaaagtagcgattagtgataatcagaaagaataccctgttgatatatcactgccagatataaacaacggtgtatatggtaacagatgattttaggatggacaacttcaaggtgaagccttgctctagggcttactcccatgacttgaccgagttccattcgttcacccagggtgatacgctaagagg

SEQ ID NO: 2309 - DNA, 262 bp, Glycine max
gccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccagaaacatccacaacaacaacacccaattaccgtcttcttcactgtcagacaaagaagcgtcgccgccggtgaaactaacacacaggtgcaccg

SEQ ID NO: 2310 - DNA, 273 bp, Glycine max
gaaataataataagtattatcttagtttgggtgcttatatatataattgcatattaataattaatggtgagggagcaccagaactactgagagatgctatgcatagtttaattacttgttttggtactcacgttgtgtgcagatccaagtgctgaagttattgctttatcaccgaccacactaatggctacgtacaggttcatatgtgaaatctgcaacaaaggatttcaaagagaccaaaaccttcagttgcaccggcgaggccacaacttg

SEQ ID NO: 2311 - DNA, 256 bp, Glycine max
gtctggaatcttcaggtccaaaccaatagcaaggtttcaaatttgtttgctggaactcaggaaaaatgtgttgcttgcaaaaaacagtttacccaattgaaaaggtagctgttgatggaacatcttaccataaggcttgtttcaggtgcactcatggggggtgtgtaattagcccctcaaattacgttgcccatgaacatcgtctttattgtaggcaccatcacactcagttgttcaagcagaaaggtaacttcag

SEQ ID NO: 2312 - DNA, 230 bp, Glycine max
gaacggaagcatacctgtttcctttatccaaattattaatgaagaaactaggcctgaaaagtgagatgaggttgagattaaatgcatgggacatccagtgcttccttcactgcaggtgcaaaatttggttgacctgtggggggttgatacagcgtctttgggacatagaatttcagcaaccattggatcctcagggaaagattttgtcatgatcctaacctatggtcgga

SEQ ID NO: 2313 - DNA, 250 bp, Glycine max
actacctctgccaattcttggtcaaaatgggggtcacctaatggtaattttgattggccagttggtgcttctgatgaaataggtaagctaagaaggtcatcatcatttgagcttgggaacaatggtgaggagcctgatttatcttgggtgcagtcacttgttaaggaatcaccagctgacgttaaaggtaaatttgcaaccactgtctcaaatgtttcagcagcagcagctggatcctccagtgagggat

SEQ ID NO: 2314 - DNA, 234 bp, Glycine max
gtcaagttcgccgactgcgcgatctgcctcaccgagttcgcagccggagacgaaatccgagtgcttcctcagtgcggacatggcttccacgtcagctgcatcgacgcctggctcagatcgcattcctcctgtccatcctgccgtcagattctggtggtttctcgctgcgacaagtgcggcgggatcccggctccggcgagttccagctcggcgccaccgctggcggactcgggg

SEQ ID NO: 2315 - DNA, 227 bp, Glycine max
caaaaatatgtggtacaagggaatacaagtgtgactgtggtaccatcttttccagaagagacagcttcattacgcacagagctttctgtgacgcactagctgaggagaacaacaaagccaacgaaggacaattgccaagataggtccaaacttgcaatgtcaacaaatcccaaacctcgtttcatcattaccaatcaacaccaacagcattgttcccaaccctgcac

SEQ ID NO: 2316 - DNA, 264 bp, Glycine max
ggcatttctcactcatctaatgcttggccgcagccaaatgttccagctcttcatttaccaggaagcaatattcaaactagccgattgagatcttctcttagtgctcgtgacatgccaccagaagactttgatgtgttgcaagattttgatggccagcaacaccttttgagtgacttgggctgtttctcgcagccccgtcctggcgccatttcagtgagtcgatctggtcggtctaagacactaaccccatcaaatctggatgaa

SEQ ID NO: 2317 - DNA, 160 bp, Glycine max
caggattgtctgaggatttgatttccaagtatttgacagaaacaatatactgttcatctgagcaaagtcaagaagaagaagcttgttgtatatgtcctcctcatggaagggtgtcatcatcagatgcaaatgcttttaatcacgaggcaagtcatttcct

SEQ ID NO: 2318 - DNA, 288 bp, Glycine max
gtgttttcggagttattcggagtgtttgggctgcacgtagaccacctggttatgcatttattgactttgatgaccgcagagatgcacaggatgctatccgtgaataggatggtatgtttagaagcatgatgttgttggcatgtaatagaattcagctcaatattataatgtgcatatatatgtatatttgctacattcttctgatctgctaatgtggtattgtttaacccccaagttttttccggttggtatgttgaagggttttcctcatctagctagttaagtctt

SEQ ID NO: 2319 - DNA, 266 bp, Glycine max
agactacatcattctgtcttgtgttagaagtaatgaacatcagggcattggatttctgaatgatcctaggaggctcaatgttgcttgacacgagcaagatatggcattgttattttgggaaaccctaaagttttgagcaaacagcctctatggaatagtttattgactcactacaaggaacatgagtgcttagttgaagggcctttaaataacttgaagcaaagtatggttcagttccagaaacccaagaagatttacaatgaacg

SEQ ID NO: 2320 - DNA, 159 bp, Glycine max
gcagtatctggcaatttgcagaatgaaatggtgcacatctatctttctgaagtacttgattggtatgctgatttaagtgctcaagaaaaatgggatgagaaagatcattccccaacaaggaaaaaattattgactgccttagagagtatagcaggatac

SEQ ID NO: 2321 - DNA, 259 bp, Glycine max
ataccactgctgttgtaatccttctcaaagtggtattggagtggttaaacaaccgatggaaggttcaaagcctcctcctcctccgcctcctcctatgttggagagaagggcaaggcctcaaaaggatcaagctttgaactgcccaaggtgcaattcaacaaacaccaaattctgctactacaacaactatagcctctctcagccaaggtacttttgcaagacatgtagaaggtattggactgagggtggttctctcaga

SEQ ID NO: 2322 - DNA, 260 bp, Glycine max
tgcttgtttcaggtgcactcatggaggatgtgtaattagcccatcaaattatgttgcccatgaacatcgtctttattgcaggcaccatcatactcagttgttcaagcagaaaggtaacttcagccaacttgacagcaagaaaacgatgaaggggtgacggagaacagaataactgagtaatggctagcattcaactttcaagttacattggcaatacaagttcagttggtgactcattttcaggcatcaaattcccttgt

SEQ ID NO: 2323 - DNA, 245 bp, Glycine max
gaaccttcctccatagacgaggttgggttgtggtatggccgccacaaagagtcaaagaagatggtcaacgagcaaagaactcctttgatggttgctgccacctacggtagcattgatgtcatgacgttgattctttctctatcagaagctgatgtgaaccgatcatctggccttgacaaaagcactgcacttcactgtgcagcttcaggtgggtctgaaaacgccgtcgatgctgtgaaactgct

SEQ ID NO: 2324 - DNA, 241 bp, Glycine max
gagccgatctacacttgatttggattccaatctggctaggacccattcatcaagtaatcattcacacaattcctaacctaatgctcaaccagcatagcgatgtagtggggtgtcactaactggtgagggttctgtgacgtatgcgaggggttggtgtccacttgatatggctccagctcttggtagggtgcaatcatcaggtactggtgctcacggtcctgaaacaagtgacttaccagtt

SEQ ID NO: 2325 - DNA, 246 bp, Glycine max
cagaggttgatcttcgccgggaaacagctggaggatggccgtaccctcgccgattacaacatccaaaaagagtcaacattgcatcttgttttgaggcttcgtggtggtatattgagccatctttgatggcactggcgaggaaatataaccaggataagatgatctgccgcaagtgctatgcccgtttacacccccgtgctgtgaactgcaggaaaaagaagtgtggtcacaagcaaccatttgagg

SEQ ID NO: 2326 - DNA, 257 bp, Glycine max
  unsure (1)..(257): unsure at all n locations
cnagctacgcttaagcctttttactgaggttttcagcggctttttgtcacaatggtgcttcaaaacgatattgatttgctgaatcctcctgctgaattggagaagagacagcacaagcttaagcgtcttgttcaatcaccaaattcgttcttcatggtataaaaacgttcttctaattgntattatttgaaatagaacntcttatttgaagcatttcgtatgttttaattatttgttgtaggatgtcaagtgccagg

SEQ ID NO: 2327 - DNA, 275 bp, Glycine max
  unsure (1)..(275): unsure at all n locations
cgatctggtcggtctaagacactaaccccatcaaatctggatgaactattctctgccgagatttcttcatctccccggtattctgacccagcagtggcttctgtattttccccaagacacaaatcaactattatgaatcagtttcaacagcttcaaagttcgttatcacccataaacacaagtgtctcctctcctagggaatgttgagcatncntctattacaggctttctttnngtgtctcttctcctggaagggatgtcnaccaaggaagtat

SEQ ID NO: 2328 - DNA, 267 bp, Glycine max
  unsure (1)..(267): unsure at all n locations
gacaacatgagttatgaggaactacttgcacttggaganagnataggccatgtgagcacaggattgtctgaggatttgatttccaagtatttgacagaaacaatatactgttcatctgagcaaagtcaagaagaagaaactgtgcaatctgtctggaagaatacaagaacatggacgatgttgggacgctgaaagcttgtggacatgattaccatgtgggttgcataaganagtggntgtctatnaagaaagtttgtcctanctgcc

SEQ ID NO: 2329 - DNA, 216 bp, Glycine max
gatttgcaaagtggtctgcagaatcgcaaattatcactctcaaccctcccagaaaagggtcgttctctcttggccactagggatttctatccaggggaagtgattataagccaagagccttacgtttgtgttccaaacaactcctcggtctccccccagaaaaggtgcgatggatgtttcactacaattaataacaacgtccttagcaggtgctcg

SEQ ID NO: 2330 - DNA, 261 bp, Glycine max
  unsure (1)..(261): unsure at all n locations
ccacgcgcctgctccacctggtcgcgccggagaaggagaagccgccgcaggaangaaagagagagggaacgaatgtggagtgttccggacgcaaatgccttcactgcggcgcggagaagacgccgcagtggcgaacgggaccgatgggaccgaaaactctatgcaacgcgtgcggcgtgaggttcaagtccgggaggctggtgccggaataccggccggcggcgagtccaacgttcatgtcaacgaagcattcganttcgc

SEQ ID NO: 2331 - DNA, 282 bp, Glycine max
cgagaaatggtggaaggctaataatgttgagatttcaccaaattgtcctaggtgtggttctaccaataccaagttctgctactacaataactacagttcaactcaaccacggtacttttgcaagggctgcagaagatactggaccaaaggaggatccctccgcaacgtgccggttggtggtggctgccgcaaaagtagaagcgctaagtataataagaccttcagacaagccaataactcagttggctattctgatgatttaatggcctcacctaattcagt

SEQ ID NO: 2332 - DNA, 277 bp, Glycine max
  unsure (1)..(277): unsure at all n locations
cantttttctaagtttgcatgtaatgcggcataccatttgtgacagtnagttgagacctgtgggaacaaggattgtaatcnggttatttcnatcatcaatcacagcngtttgcccaattctgtgttggtttttgagggaagctcagctttggtacgtgcggtgcagcatataccctcaggtactgaggtgctgataagttacatacgagactgctgaaagcactatgactcgacagaaggctctcaaagagcagtacctattcacttgtacatgtcc

SEQ ID NO: 2333 - DNA, 299 bp, Glycine max
ctcatcatggccatagtttccttatcagtggtcttggttcttgtctttgcacttcacctctacgcaagggttttcctccgccgccaaactcgccgcagagccgccatataccaactgagcctcaacgtggcacaagcacacgccgagccacacaacaacacagggctgaaccctgccctcatcaccacccttccctccttccccttcaaacaaaaccaacaccatgattctgctgagtgtgccgtgtgcttgagcgttctagaagacggagaacagtgaggcttcttcccaattgcaaa

SEQ ID NO: 2334 - DNA, 270 bp, Glycine max
  unsure (1)..(270): unsure at all n locations
cgagaaaggacattagcaaaaagggccatgagaatggggtttttctctganaggtatgccaatttagcatctctccctctgcatggttctttcaggtccttgggaataaaggcgcactcctcactgcaccatggtttcttaccaacnatgaggcctcctgagataaagagcaatgcnagatatgatcaagggtatctggccacccggatatccttggaggttnnnggnnccannttttttgtggccctgaaattttncgcnaattgnggg

SEQ ID NO: 2335 - DNA, 282 bp, Glycine max
  unsure (1)..(282): unsure at all n locations
tgcnagtncgcgcacggcntttttcgagtgatggctacacncggngcgctatcaccactcagccttgcaaggacggcacgagttacccggncngcgggtgtgcttcttcgcgcacangccggancagctgcgcgtcttgccgatgcagagtccgcgtagncggcgaactcgtctgagtctacgatggttcgccgatgagacagatgatgtctccggcggcgttcatgtcctctccggcggttctctctctctccggagtctccgccggtgtcgccntcgatt

SEQ ID NO: 2336 - DNA, 262 bp, Glycine max
  unsure (1)..(262): unsure at all n locations
gtncgcaancatcgcataannagagaaaggcctcgagcttctcttgttcgtgaatttcatggtatgngtagtcgcctantgaaancaatgccgagtnntggtatttacntctgttttggaagataactgtacatcaagaacatgtgctatatgccttgaagactatngtgttggtgagaagctcaggattctgccctgctgtacacaagtttcatgctgcctgtgtggattcgtggatacttcatggagaaccttttgtgcc

SEQ ID NO: 2337 - DNA, 278 bp, Glycine max
  unsure (1)..(278): unsure at all n locations
ctgttactacttaaccacatattttggtgcatcttttctttttccctcacncaattcatcatggctgaaattgaataccatgcaaaatccaatactaacactcaacccctaaagctctttggcatcaacattagcaagtccccagaagatcaaactcatgaagcaggttcgaattctgagcctttcagttcaagaaagtacgagtgtcagtactgttgcagagaatttgcaaactcacaggcactaggagggcatcaaaacgcgcacaaaagaaagac

SEQ ID NO: 2338 - DNA, 275 bp, Glycine max
  unsure (1)..(275): unsure at all n locations
cnaatganagcntttggngaggttaaagccagtnctgtatccaactctattttctattctgataagcgcatctcaacccaaaagcctcatgatgaacaaactttgaccaattgangactggaggattccttttgccaagcntgcttganctgcagctaataacgatgttgaaggtttcaagcgaatgattganagggatccttcctgtgtagatgaggtaggactatggtacagtcgtcaaaagggatctaggcggatggtcaatgagctcagaa

SEQ ID NO: 2339 - DNA, 279 bp, Glycine max
  unsure (1)..(279): unsure at all n locations
cgtttgcaacaaggcttttccttcttaccaagcactcggtggacacaaggccagccaccgcaaggcctcgtcggaatccaacaccaccgcctccgccgtcgccgtctctgccacagccaacgacagcgtttccgcttcgaccgtcggcggcggaaggatgcacgagtgttccatctgtcacaagagtttccctaccggtcaggccctgggtggccacaagcgctgtcactacgacggcggaaacaanccacagtaacagcaacgccaacggcaacaaca

SEQ ID NO: 2340 - DNA, 286 bp, Glycine max
  unsure (1)..(286): unsure at all n locations
aggatttcncatgctagctcagncgcgagaagcaacaatttcgcagcttaagcttccnagaactnggctccntatctgctgctgcnttntgccgattcttggtcaaaatggggatcanctaatgttaatnggattggccagttggtgctggtgaagttggtaagctaagaaggtcatcatcatttgagcttnncgaacaatggtgaggagcctgattnatnttgggtgcagtcacttgttaaggantcaccagctgaagttaanataaatggcaaccatgtctcat

SEQ ID NO: 2341 - DNA, 280 bp, Glycine max
caagaatgaagagaaaaacccaccactgacacctctaggaactgatgatagtaataactacaattcttctgcaaaccacagcaatatcactgttagggtttgttctgattgccacaccactaagacccctctctggagaagtggaccaaaaggtccaaagacactttgcaatgcttgtggaattcgacaaaggaaggcaaggcgtgccattgccgtggctgcaacggcaaacggaatgaatccggtggaggctgagaaatctcaagtaaagaaaggaaac

SEQ ID NO: 2342 - DNA, 273 bp, Glycine max
gttgtgtgtgcatgtcaaggttaaaggccaaagatgaaatccgtgtccttccttgctcgcacaaattccataagacttgtgtaaatagatggcttaagggtcgccacaaaacgtgtccactctgccgtttctcgatgggagccgaggagaagtctcatcgtgcagaaatgttcactgaagagatgttaatatggttttcttctttccatgtagctggtatgtaatgatccaagtttcaccatggaatctatatgtagttttctccaagcagag

SEQ ID NO: 2343 - DNA, 264 bp, Glycine max
aacattctttacttattgtaccctccattatatgagtatatttattaaaactttgggtctcgggatgtagatgtttggaaatattccaaagaagtcatggttagtaatcactgaacatccaaagcctgcgtgatagatgattaccagctttacagctatcattcacaagaactgcaaataggcttgctattcaattccatctacatccttgtgggagtgacatttgattggcaaaattattactcaccagatactctcacccca

SEQ ID NO: 2344 - DNA, 239 bp, Glycine max
ccggcacttacttgtgagctctttgattctatcaaagttgacattgacttgacttgttctatatgcttggacaccgtgtttgatccagtttctctgacttgcggccatatattctgctatatttgtgcatgctcagctgcatcagtatctattgttaacggacttaagtctgcagatcctaaaatgaagtgtcctctatgtcgtgagggagcagtttatgaaggtgctgtgcacttgga

SEQ ID NO: 2345 - DNA, 272 bp, Glycine max
atggcatttcagcactacatttcccgggatttgaaaaccatcccaaatgctgcgactgagacagaaaactccaatggttgttttgattgcaacatctgcctagactttgcacatgagccggtggtgaccctatgtggccacctctactgctggccatgcatctacaagtggctccatgtccaaagtgattctcttgcacctgatgagcatccacaatgccccgtttgcaaggcagatatatccaatagcacaatggtcccactctatggccg

SEQ ID NO: 2346 - DNA, 254 bp, Glycine max
aaaattgctgcaatagagggtgcagaggacacaaaagttagtttaagcagcactgacagtggcaggagtgatggtgatgcagatgaatataatgatggtagtcctactatcatgcttgatgagatccttgatttgttgagccgcaggtgggatagaataaatggagctcaggcccttaaacttttaccaaaagagacaaaattacaggacctactttcatttcttggaccccttctgagaaaatctagtgaaat

SEQ ID NO: 2347 - DNA, 254 bp, Glycine max
cccatctctcaaagctttacacgcttttaacactctctagaaaagtggtgttcttttttctttctctgaggactcgttgcttttcctttttcccattctcttcttaaatccatggacacggctcagtgggcacagggtattggagtggttaaacaaccgatggaaggttcaaagcctcctcctcctcctcctcctcctatgttggagagaagggcaaggcctcaaaaggatcaagctttgaactgcccaaggtg

SEQ ID NO: 2348 - DNA, 277 bp, Glycine max
agcatttgtaactgcttctctgaatttgtctgagtctgagctgttaattctcccaacacaattataaaaagaagaaaaacttagagtgatagttgtaggaaagtaaaaacagtaagtgttctcttaattcagtgaggttctgaattgttcaacttgagatgatggcatcatttgcagggactactcagaagtgcaaagcatgtgagaagactgtgtatttggtggatcagctcactgctgacaacaagatctatcacaaatcatgtttcagatgcta

SEQ ID NO: 2349 - DNA, 271 bp, Glycine max
atgaatttgctgatggagagaatgttggatcactggattgtgggcatgagttccatagtggctgcatcaagcagtggctaatgcagaagaacctctgccctatttgcaaaacaaccgccttagctacttgatagggagaacctctatcctcttaagctggttctacctatagcttcttttattttttaaactttatgaacttctttgaactggacctctcatttgtcatgattggggacgataacatgtcccctaaagagaagtaaacaaa

SEQ ID NO: 2350 - DNA, 273 bp, Glycine max
cacaaaaaagcaacatggcttcaattcgcgccttcttcacagccattgcttttgtggctcaatcatttcaaaactacatgatccagagtctgcacaaactttacaagcattatggatatgctgctgaagtgaaggacaatgaagagaaagaaagtgattattgttctgtgtgtctaagccaaatttgtaaaggggaaaaagctaagtctcttcccgtgtgcaaccacagataccatgttgattgtattggtgcttggttgaagaatcatacca

SEQ ID NO: 2351 - DNA, 272 bp, Glycine max
cttacattttttctctcggagcaaaggttttgaatttcagttatagccttttgctgtcttttgttttttattcttttgaaatttggatattttttcagggtattggagtggttaaacaaccgatggaaggttcaaagcctcctcctcctcctcctcctcctatgttggagagaagggcaaggcctcaaaaggatcaagctttgaactgcccaaggtgcaattcaacaaacaccaaattctgctactacaacaactatagcctctctcagcca

SEQ ID NO: 2352 - DNA, 268 bp, Glycine max
cttaacccctccgtaaaccctagtatagctggaaagaagcagtagctttgccgctctgaatcgaaattcctcagttcagtcgctgccgtcgtctcgtcgttttactccagaagaatgatgaagaaagtggacgagcgaatcagaactttaattgaaaatggcgtcagaacaaggcataggtctatgttcatcatcattggcgacaagtcccgtgaccaggtctttttatattatagattgtaaatctacactacatgcttagcaaggc

SEQ ID NO: 2353 - DNA, 253 bp, Glycine max
ctcgagaattctttttgttgaactcacttctctcttgttcgccacgcactcttgtctctgcaagttgtctgggttgctcgtagaccaccaggatatgcatttattgagtttgatgatcggagggatgcacgtgatgcaattcaggccttggatggaaaaaatggttggcgtgtagagctttctcataattccaagggtggtggccgaggagggcgtgggcgtggaggtgaaggcacaaaatgctatgaatgtg

SEQ ID NO: 2354 - DNA, 262 bp, Glycine max
gcagattcttttggtttctaaacatgatcgtcactgcctccatctgtaatcgctaattgaaggcatgggaggtggtccagagaaatcaaaatctccttcaacttcgtcttccctttaggtgtaaaagtcacagctaacgatatagaaatgaaatcgctaactgttaacactgaagattctttttccagtttactggaacttgcttctaacaatgatattgaaggcttcaaggtccttttagagaaggattcttctacgatca

SEQ ID NO: 2355 - DNA, 291 bp, Glycine max
ccgcattgatgtggataacatgtcctatgaggagctattggctctggaagaacgcattggaaatgtgagcactggattaagtgaggagattgtatcgaaacttttgaaaaagaagaagtattcagctgaaccagattctcagcatgaggcagaaccatgctgtgtttgtcaggaggagtataaagatggggatgatttaggatcactggattgtgggcatgattaccatagagattgtattaaacagtgcgtaatgcataagaatttgtgtcccatttgtaagacaacggg

SEQ ID NO: 2356 - DNA, 187 bp, Glycine max
ctggtctaccaattgaccattctaacatggtcgatctttcaactcaaacttctgcactttgagcagggattggagcccaatgagtatatgtcctcctcatggaagggtgtcatcatcagtcatttccttattggaagcagttctagtaatgctcctgtagatgttggaggttttcataatgaatttg

SEQ ID NO: 2357 - DNA, 261 bp, Glycine max
ctgatctcaaaggatatgaaggcagataatacttgctgtgcaatatgtttgcaggatattgaagtaggcgaaattgcacgaagcttacctcgctgtcaccatacatttcacttgatatgtgtggacaaatggcttgtcaagaatgattcgtgtcctgtttgcagacagaatgtgcaacttgttccttgggcaatttgagattatcttaatgggcggatgcatatgtggaataattggttccttataatccaactgggatta

SEQ ID NO: 2358 - DNA, 256 bp, Glycine max
  unsure (1)..(256): unsure at all n locations
tccaggatacaatccagaggctttgctaaaacgtcttccactagatgctttgtctcgnagatcatgctatattgttggggattatgaaccgacatgaactgccattatctttgtatgttcttaagcttaatgctccagaattggcattgtcttattgtgatcgggtctatgagtctatgcatcagccatctgcaaaaaattccagcaacatataccttctgcttttgcaaatttatttgaatcctcgaaggaccaa

SEQ ID NO: 2359 - DNA, 262 bp, Glycine max
  unsure (1)..(262): unsure at all n locations
ttcattcttataataatcattattttcttccacaccttcgtccgcttctgncgccgtcgccgccgtcgcctcttctctcgttcgcttccgaccaattcctccgccgccgcctctctcgacgacccgtgcctcgacccttccgtcatcaagtcccttcccacttttactttctccgccgccacccaccgctctctccaggactgcgccgtttgcctgtcggagttcgccgacggcgacgagggccgcgtgctcccgaattgta

SEQ ID NO: 2360 - DNA, 251 bp, Glycine max
gagaatgcaggatccaacgttgttccaacccatgaaaccccactttccggaacaggagcagcttaaatgaccgaggtgtgactccaccaacaccaagttctggtaatacaacaactacaacctctcgcagccacgccatttttgcaagaactgcagaaggtattggaccaaaggtggtgccctgagaaacatccctgttcgtggtggaagcagacagatcacaaagcgatcatcttcatccaacaacaaca

SEQ ID NO: 2361 - DNA, 263 bp, Glycine max
cagaaacatccacaacaacaacacccaattaccgtcttcttcactgtcagacaaagaagcgtcgccgccggtgaaactaacacacaggtgcaccgtttgcaacaaggcctttggttcttatcaagcactcggtggacacaaggccagccaccgcaaggcctcgtcggaatccaaccccaccgcctccgtctctgccctagccaacgacagcgtttctgcttccaccgtcggcggcggaaggatgcacgagtgttccatctgta

SEQ ID NO: 2362 - DNA, 271 bp, Glycine max
cgcgaaatgtggaacctatttctccaatgggttctaggatttctatgctagctcagcgcgagaagcaacaatttcgcagcttaagcttccgagaactcggctccaactctgctgctgcctctgccgattcttggtcaaaatggggatcacctaatgttaaattggattggccagttggtgctggtgaagttggtaagctaagaaggtcatcatcatttgagcttgggaacaatggtgaggagcctgatttatcttgggtgcagtcattgtt

SEQ ID NO: 2363 - DNA, 251 bp, Glycine max
catcatccgataatgcaaattcttcatcagaaacaacaacaacaacaacaacaaaccctcttggtaattctgatgctactgagcctagagtgttctcttgcaactactgccacagaaagttctacagttcacaagcactaggtggccaccaaaatgcacacaagagagagaggtcaattgcaaagagaggacacaggtttggatctcagattatggcctttggccttccccttttgcatcataacaacaac

SEQ ID NO: 2364 - DNA, 163 bp, Glycine max
gggctgtgctagaaaagtatgcttctttgctcacaaacctgaagatctacgccctgtgtatgcttccactgggtcggctatgtcatcaccaaaatcctattcagctagtggacttgacatgacagtgatgagtccattggctcttagttccacacaacatacg

SEQ ID NO: 2365 - DNA, 276 bp, Glycine max
aaagctcatggtcacagatctttcgtgccatcaagagttaccgaacccaaccatgaaacaacaacctaggatgcatccgtgtccgatttgtgggcttgagtttgctattggacaagctttgggagggcacatgagaaagcatagaactgctattaatgatggcttgttgtgtggtaaaccttcttcttcgttgtccatcttgaaggaatcatcgaaagatggtgatcaaaagttgaatttgcgcttggacttgaacttgacgccattggaggagga

SEQ ID NO: 2366 - DNA, 278 bp, Glycine max
gggatcgatgacatatattgtctcttcttggggagcttgaacaacttgtccctactcaacaagcaatatggattgtcaaagagtactgatgaggccatgtttgttattgaagcttacaagacactccttgacaacttgatctgcagggtatggacccccagatattcgtgaaaaccctaaccgggaagaccatcacccttgaggtggagtcaagcgacaccattgacaatgtcaaagccaagattcaggacaaagaagggattcctccggatcagcag

SEQ ID NO: 2367 - DNA, 247 bp, Glycine max
tcctatttgtcgtaagctgtcgtactttgtcattccaagtgtcatttggtactcaacaactgaagaaaaacaagaaatcattaacaactacaaggcaaagctcaagtcaattgattgcaagcactttgactttggggaaggaaactgcccttttggaactagttgtttctacaagcatgcatttcaagatggccgtctggagcaggtagttttgcgacatctaggggctgcagagggtgatactgta

SEQ ID NO: 2368 - DNA, 212 bp, Glycine max
atttgtacatcccggcgagaaggcccgccgtcgggaccctcgccggtttcattactctgcaacagtctgtccagagtttcgccgcggtcagtgtgaccgtggcgatgcatgtgagtactctcatggggtgtttgagtgctggttacacccttctaggtatagaaccgaggcttgcaaggatggaaggaattgcaagcgaaaagtttgcttct

SEQ ID NO: 2369 - DNA, 252 bp, Glycine max
gctggtgggtccgagctcataatcaccacgaaatctggtgatagatcatcaaccaaaacacttggttcccgtgaatttttgcgttattatcgtcagaaacctcggccatcactagcaaatatggctatcactgctgcattggcttcaaggtacaggagcctgggcttgaccactatccaatcaagggagaagattgtgaggatgaaagtgctgaaggaaatgaataggtcaggtgtggacaatatgcgtacc

SEQ ID NO: 2370 - DNA, 263 bp, Glycine max
gtttctcactctctctcatgttcactcaacaacaacgacgcactcactgacatcaacactagtttcaggtgctatctcatccaccaaatgcagcaaatacactccatgcccggagggaggtttttctccggctccggatccgccgaccggaggctccgaccccaccatcagaaccagcaggccttaaagtgcccccgctgcgactctctcaacaccaagttctgctactacaacaactacaacctctcccagccccgccactt

SEQ ID NO: 2371 - DNA, 172 bp, Glycine max
gctgcttcaacataacaactgtgtttagccactctcagactgttgtggtttccggaaactgccagactgtgttgtgccaaccaacaggcggacgggcaaggttaaccgaaggtgctcttgtggaaggctgagagagatattgtcttacaatttaacaaaattaatataccat

SEQ ID NO: 2372 - DNA, 245 bp, Glycine max
cgcttgagtcggacttcgtggtgattctcgcggcgctcctctgcgccctcatctgcgtggtggggctggtggccgtggcgcggtgcgcgtggttccggcaaggctccggcggcggaagctctccccggcaagccttggcgaacaagggcctaaagaagaaggtgctgcagtcgctgccgaagttcgcgtacgtggacagcaaccccagcaagtgggtggcgacatcggaatgcgcgatctgcctc

SEQ ID NO: 2373 - DNA, 286 bp, Glycine max
ctcagcccctcggagggtttcattgaagagttcagaagcaggacaccaacacttaggtttggcagcatgtgtggcagtaaacaacctcaacatgaatgttgttgtgtgtgtctcacaaagtttgaaccagaatctgagataaactgtttatcatgtggccatatttttcacaaagtgtgcatggagaagtggttggactattggaacattacatgcccactttgcaggacttccttgatgcctgaagatgatgcatcttgcttttggtaaaaaaacatgtacatat

SEQ ID NO: 2374 - DNA, 253 bp, Glycine max
gcaagtctcaattaggcactgtctgcatttggggcatgaagagtgtgaacttagccatttgtcaatgcagcgaatatggaacccgtggttgcactttggcaaaatgcgcaccttttcaccacttgtgaactctgacaagcatatcacacactctgagtccaaacttggcaagtttagctcagctgagtaactcactgtggtgaaagtcttgagtgctttcttcttcactcctgtgttggcaactcttgctgct

SEQ ID NO: 2375 - DNA, 280 bp, Glycine max
aacaaagtgaagtgatgaacggagacaaggacaatcatggaagcgaagatggcaaccccaaagagtggttgaacctgagcataggtggaacttcttcactatcaacatctggagacactgattcacaagcaagaccaccagccactgccaaagttttttcatgcaacttctgcatgaggaagttctttagctcacaagcactaggaggccatcagaacgcgcacaagagggacaggggagctgccagaagataccaatctcagagatcgatggcaataat

SEQ ID NO: 2376 - DNA, 406 bp, Glycine max
aaaaaacaccatgatgcttggggagacccaccgcccaaatccaaccgtacacgtgccaccgtgggcgccggagatcttctcaccatacaccggcaatgccgattactctccgtactccatgcaagaagcacttagtgcacttcagcactacgaatccaccgatgctgagtcagactcggaggttccgtctcgggaaccggaagtcccggtggacgcttactcctgcgaccatttccgcatgttcgagttcaaggttcggagatgcgcacgttgcaggtcgcatgactggaccgactgtccgtacgcccaccccggcgagaaggcacgccgccgtgatccccggaagtaccattactccggcacggcttgcctcgatttccgcaaggggagttgcaagaagggtgac

SEQ ID NO: 2377 - DNA, 256 bp, Glycine max
gcgaacggcgaggacaacgtgctgataacgccggtgccgcggttcccggacaagagcgacgacacggaggacatgaagatttgcctctcgaaggtgtacaaagcggagaaggtggaattgagcgaggacagaatgagcgcggggagcaccaagggttacagaatggttagggccacgcgcggggtggtggaaggcgcgtggtactttgagattagggttgtgaagttgggagagagtgggcacacgcgcctcgggt

SEQ ID NO: 2378 - DNA, 416 bp, Glycine max
acggtctaggattcccgggacgcagtcagacggctaccagaagacgacagaagggggaaaactaagtggtataagagctgaaaaaccctaataacaatgggaggaaaatgtccgcacaggaacgtgaagaagagaagatattctcacaagaccgcgcggcgatacaaatttgagctgaaaggggacgacatggtttatgcgcagctcaacaaacccgatcaagagagaccccctttacccgtcgacgaagatttgcctgagatgggccagtactattgccttcactgcgatcggtactttgccaatataactgtgagggatgagcactttaagaccaaacgacacaagaagcgtataaaacaaatgatgggtcctgcaccacatactcaacttgatgccgatttagcttctgggat

SEQ ID NO: 2379 - DNA, 293 bp, Glycine max
  unsure (1)..(293): unsure at all n locations
tttgggttttgtagatggcaagtgggtttggggaatcaacagggagatcacccccaagccctcctacttcaacaacaataataacaatgatgctgccaattttgaatgcaacatttgctttgaattagcgcaagacccgataattactttgtgtggtcatcttttctgctggccctgtctttacaaatggcttcactttcactcacaatcacgagaatgcccggtnnngcaaggccctcgtggaggaggagaagctggttcccttgtatgggagaggaaagtcgtcgactgat

SEQ ID NO: 2380 - DNA, 228 bp, Glycine max
cttctctctatctgcagatggcaagtgggtttggggaatcaacagggagatcacccccaagcccttcctacttcaacaacaataataacaatgatgctgccaattttgaatgcaacatttgctttgaattagcgcaagacccgataattactttgtgtggtcatcttttctgctggccctgtctttacaaatggcttcactttcactcacaatcacgagaatgcccgg

SEQ ID NO: 2381 - DNA, 245 bp, Glycine max
gtttgggttttgtagatggcaagtgggtttggggaatcaacagggagatcacccccaagcccttcctacttcaacaacaataataacaatgatgctgccaattttgaatgcaacatttgctttgaattagcgcaagacccgataattactttgtgtggtcatcttttctgctggccctgtctttacaaatggcttcactttcactcacaatcacgagaatgcccggtgtcgcaaggccctcgtgg

SEQ ID NO: 2382 - DNA, 418 bp, Glycine max
acccacgcgtcaggctgcgagaagacgacagaagggggcaagtcacacatacacgatatgataccccgtcctccctctcttcacttttgactattgacttcctcaaccgatccactcttctctctatctgcagatggcaagtgggtttggggaatcaacagggagatcacccccaagcccttcctacttcaacaacagtaataacaatgatgctgccaattttgaatgcaacatttgctttgaattagcgcaagacccgataattactttgtgtggtcatcttttctgctggccctgtctttacaaatggcttcactttcactcacaatcacgagaatgcccggtgtgcaaggccctcgtggaggaggagaagctggttcccttgtatgggagaggaaagtcgtcgactgatccaaga

SEQ ID NO: 2383 - DNA, 289 bp, Glycine max
gttgaaccaatctctccaatgagtgctcgtttatctgcatttgctcagcgagagaaacagcagcaacagctgcgcagtgttagttcaagagaccttggtgccaacagtcctgcctcacttgttggctcccctgcaaacccttggtcaaagtggggttctcctattgggaaagctgattggtcagtaaatggagactcccttggtcgtcagatgcgaagatcatcctcgtttgagcgcaagaacaatggggaagagcctgatctctcttgggtccaatctctggtgaagg

SEQ ID NO: 2384 - DNA, 246 bp, Glycine max
gttgaaccaatctctccaatgagtgctcgtttatctgcatttgctcagcgagagaaacagcagcaacagctgcgcagtgttagttcaagagaccttggtgccaacagtcctgcctcacttgttggctcccctgcaaacccttggtcaaagtggggttctcctattgggaaagctgattggtcagtaaatggagactccttggtcgtcagatgcgaagatcatcctcgtttgagcgcaagaacatgg

SEQ ID NO: 2385 - DNA, 270 bp, Glycine max
caacagtcctgcctcacttgttggctcccctgcaaacccttggtcaaagtggggttctcctattgggaaagctgattggtcagtaaatggagactcccttggtcgtcagatgcgaagatcatcctcgtttgagcgcaagaacaatggggaagagcctgatctctcttgggtccaatctctggtgaaggagtccccacctgagatgatcaaagagaagtttgcatctcctatgcctactgcatctgctgatggaccgattcaattcccaat

SEQ ID NO: 2386 - DNA, 274 bp, Glycine max
attcggctcgagattcaaactagccgattgagatcttctcttagtgctcgtgacatgccaccagaagactttgatgggttgcaagattttgatggccagcaacaccttttgagtgacttgggctgtttctcgcagccccgtcctggcgccatttcagtgagtcgatctggtcggtctaagacactagccccatcaaatctggatgaactattctctgccgagatttcgtcatctccccggtattctgacccagcagtggcttctgtattttccc

SEQ ID NO: 2387 - DNA, 262 bp, Glycine max
attttgatggccagcaacaccttttgagtgacttgggctgtttctcgcagccccgtcctggcgccatttcagtgagtcgatctggtcggtctaagacactaaccccatcaaatctggatgaactattctctgccgagatttcttcatctccccggtattctgacccagcagtggcttctgtattttccccaagacacaaatcaactattatgaatcagtttcaacagcttcaaagttcgttatcacccataaacacaagtgt

SEQ ID NO: 2388 - DNA, 272 bp, Glycine max
aaatcattacatggtcatagtctacacctaattagccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaac

SEQ ID NO: 2389 - DNA, 291 bp, Glycine max
  unsure (1)..(291): unsure at all n locations
gacactcaaattacatggtcatagtgtacacctagttaggcaaacacaccaaacaccaaacaccaaactagttggctcaattctctttgaatggctttggaggctttgaattcaccaacagcagccaccactccgttccgtggctaccnnnnnnnnnnnnnnnnnnnnnnnnctgaccttcacttacgtgagccttgggctaaaaggaaacgctccaaacgaccgcgttttgagacggaggaagagtacctcgctctttgcctcatcatgctcgcacaaagcggtaacacc

SEQ ID NO: 2390 - DNA, 279 bp, Glycine max
  unsure (1)..(279): unsure at all n locations
tggtcatagtgtacacctagttaggcaaacacaccaaacaccaaacaccaaactagttggctcaattctctttgaatggctttggaggctttgaattcaccaacagcagccaccactccgttccgtggctaccnnnnnnnnnnnnnnnnnnnnnnnnctgaccttcacttacgtgagccttgggctaaaaggaaacgctccaaacgaccgcgttttgagacggaggaagagtacctcgctctttgccttcatcatgctcgcacaaagcggtaacaccag

SEQ ID NO: 2391 - DNA, 285 bp, Glycine max
  unsure (1)..(285): unsure at all n locations
atcattacatggtcatagtctacacctaattagccaaacacaccacagcaccanactagttggctcaantctctttgaatggctttggaggctttgaattcaccaacagcagccaccactcccttccgtggttaccaagaagaggaggaggaggttgaccttcacctacgcganccttgggccaagagaaaacgctccaaacgacctcgttttgagtcggaggaagagtacttggctctttgcctcatcatgcttgcacaaagcggtaaaacaacaacacccaat

SEQ ID NO: 2392 - DNA, 263 bp, Glycine max
  unsure (1)..(263): unsure at all n locations
ctcaaattacatggtcatagtgtacacctagttaggcaaacacaccaaacaccanacaccaaactagttggctcaattctctttgaatggctttggaggctttgaattcaccaacagcngccaccactccgttccgtggctaccnnnnnnnnnnnnnnnnnnnnnnnnctgaccttcacttacgtgagccttgggctaaaaggaaacgctccanacgaccgcgttttnagacggaggaagagtacctcgntntttgcctcatc

SEQ ID NO: 2393 - DNA, 271 bp, Glycine max
cctaattagccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggagagtacttggctctttgcctcatcatgcttgcacaaagcggtaacaacaacaacacccattaccgtcttcg

SEQ ID NO: 2394 - DNA, 260 bp, Glycine max
cctaattagccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacaccca

SEQ ID NO: 2395 - DNA, 257 bp, Glycine max
accaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtcttcgtcacagtca

SEQ ID NO: 2396 - DNA, 280 bp, Glycine max
catggtcatagtctacacctaattagccaaacacaccacagcaccaaactagttggctcaattctctttgaatggctttggaggctttgaattcaccaacagcagccaccactcccttccgtggttaccaagaagaggaggaggtcgttgaccttcacctacgcgagccttgggccaagagaaaacgctccaaacgacctcgttttgagtcggaggaagagtacttggctctttgcctcatcatgcttgcacaaagcggtaacaaacaacacccaattac

SEQ ID NO: 2397 - DNA, 261 bp, Glycine max
actcaaattacatggtcatagtgtacacctagttaggcaaacacaccaaacaccaaacaccaaactagttggctcaattctctttgaatggctttggaggctttgaattcaccaacagcagccaccactccgttccgtggctaccaagaagaggaggaggaggaggaggctgaccttcacttacgtgagccttgggctaaaaggaaacgctccaaacgaccgcgttttgagacggaggaagagtacctcgctctttgcctc

SEQ ID NO: 2398 - DNA, 259 bp, Glycine max
agccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattacc

SEQ ID NO: 2399 - DNA, 255 bp, Glycine max
cctagttaggcaaacacaccaaacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggt

SEQ ID NO: 2400 - DNA, 280 bp, Glycine max
cagacactcaaattacatggtcatagtgtacacctagttaggcaaacacaccaaacaccaaacaccaaactagttggctcaattctctttgaatggctttggaggctttgaattcaccaacagcagccaccactccgttccgtggctaccaagaagaggaggaggaggaggaggctgaccttcacttacgtgagccttgggctaaaaggtaacgctccaaacgaccgcgttttgagacggaggaagagtacctcgctctttgcctcatcatgctcgcaca

SEQ ID NO: 2401 - DNA, 268 bp, Glycine max
aattagccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtctt

SEQ ID NO: 2402 - DNA, 241 bp, Glycine max
aaattacatggtcatagtgtacacctagttaggcaatcacaccaaacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagta

SEQ ID NO: 2403 - DNA, 262 bp, Glycine max
actcaaattacatggtcatagtgtacacctagttaggcaaacacaccaaacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctca

SEQ ID NO: 2404 - DNA, 251 bp, Glycine max
cacatggtcatagtctacacctaattagccacacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggcctctttgcctcatcatgctt

SEQ ID NO: 2405 - DNA, 275 bp, Glycine max
catggtcatagtctacacctaattagccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaactacaacaacacc

SEQ ID NO: 2406 - DNA, 276 bp, Glycine max
ctcgagccggtctacacctaattagccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacaccca

SEQ ID NO: 2407 - DNA, 260 bp, Glycine max
caaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtct

SEQ ID NO: 2408 - DNA, 251 bp, Glycine max
caaacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccagaaacatc

SEQ ID NO: 2409 - DNA, 264 bp, Glycine max
ctagttaggcaaacacaccaaacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccagaa

SEQ ID NO: 2410 - DNA, 279 bp, Glycine max
atggtcatagtgtacacctagttaggcaaacacatcatacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccag

SEQ ID NO: 2411 - DNA, 276 bp, Glycine max
atagtgtacacctagttaggcaaacacaccaaacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacacagcggtaacaccagaaa

SEQ ID NO: 2412 - DNA, 276 bp, Glycine max
agaagacgacagaaggggatctacactcataaatcattacatggtcatagtctacacctaattagccaaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcc

SEQ ID NO: 2413 - DNA, 395 bp, Glycine max
cacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtcttcgtcacagtcacacacagaagcgtcaccgccgctgaaactatcacacaggtgcaccgtttgcaacaaggcttttccttcttaccaagcactcggtggacacaatgccagccaccgcaatgcctcgtcggaatccaaacacacc

SEQ ID NO: 2414 - DNA, 394 bp, Glycine max
tacggctgcgagaagacgacagaaggggatctacactcataaatcattacatggtcatagtctacacctaattagccaaacgcaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtcttcgtcacagtcacacaaagaagcgtcaccgccgctgaaactatcacacaggtgcaccg

SEQ ID NO: 2415 - DNA, 387 bp, Glycine max
tacggctgcgagaagacgacagaaggggatctacactcataaatcattacatggtcatagtctacacctaattagccaaacacaccacagcaccaaactagttggctcaattctcgttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacacccaattaccgtcttcgtcacagtcacacaaagaagcgtcaccgccgctgaaactatcacacaggtgc

SEQ ID NO: 2416 - DNA, 355 bp, Glycine max
ggcaaacacaccaaacaccaaacaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccagaaacatccacaacaacaacacccaattaccgtcttcttcactgtcagacaaagaagcgtcgccgccggtgaaactaacacacaggtgcaccgtttgcaac

SEQ ID NO: 2417 - DNA, 416 bp, Glycine max
ctcaaattacatggtcatagtgtacacctagttaggcaaacacaccaaacaccaggcaccaaactagttggctcaattctctttgaatggctttggaggctttgaattcaccaacagcagccaccactccgttccgtggctaccaagaagaggaggaggacgaggaggctgaccttcacttacgtgagccttgggctaaaaggaaacgctccaaacgaccgcgttttgagacggaggaagagtacctcgctctttgcctcatcatgctcgcacaaagcggtaacaccagaaacatccacaacaacaacacccaattaccgtcttcttcactgtcagacaaagaagcgtcgccgccggtgaaactaacacacaggtgcaccgtttgcaacaaggcctttggttcttatcaagcactc

SEQ ID NO: 2418 - DNA, 415 bp, Glycine max
atggtcatagtctacacctaattagccaaacacaccacagcaccaaactagttggctcaaggctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtcttcgtcacagtcacacaaagaagcgtcaccgccgctgaaactatcacacaggtgcaccgtttgcaacaaggcttttccttcttaccaagcactcggtggacacaaggccagccaccgcaaggcctcgtcg

SEQ ID NO: 2419 - DNA, 235 bp, Glycine max
gatggattgcatatggtgtccgaaagttactcttctagacagccaaggccattgaccaccgttggctggcagaacaataatagaaatggaaggtcaagaatacctagtgacagatatcggtcattggatgatgagggtttcatgattgttgatcgcacttcactgtatggacctaggaatatgcttgatcgacatagagacatgaggatggacatagacaacatgagttatgagg

SEQ ID NO: 2420 - DNA, 221 bp, Glycine max
  unsure (1)..(221): unsure at all n locations
gaaggtcaagaatacctagtgacagatatcggtcattggatgatgagggtttcatgattgttgatcgcacttcactgtatggacctaggaatatgcttgatcgacatagagacatgaggatggacatagacaacatgagttatgaggaactacttgcacttggagagagaataggccatgtgancacaggattgtctgaggntttgcttcccaagtatncc

SEQ ID NO: 2421 - DNA, 265 bp, Glycine max
tgcatatggtgtccgaaagttactcttctagacagccaaggccattgaccaccgttggctggcagaacaataatagaaatggaagatcaagaatacctagtgacagatatcggtcattggatgatgagggtttcatgattgttgatcgcacttcactgtatggacctaggaatatgcttgatcgacatagagacatgaggatggacatagacacacatgagttatgaggaactacttgcacttggagagagaataggccatgtga

SEQ ID NO: 2422 - DNA, 273 bp, Glycine max
  unsure (1)..(273): unsure at all n locations
cacaaccaaatncaacatggtagccattctgaagagacaaagagaaacanaagccgaggagagcatcataagactggcagaaagtctcatgcaactgtcgcgagtccaacaaaaaagcaagcctcttctcaaaaccttttctccaacggagttcgagtgcaaaacctgtaaccgcaagtttccatcttttcaaggccttggtggtcacaggggagccacaagagnccaagtcggaggtggaggactcnaagagaggccaagaaggtntgagtt

SEQ ID NO: 2423 - DNA, 261 bp, Glycine max
acaacacaacacaaccaaatccaacatggtagccattctgaagagacaaagagaaaccgaagccgaggagagcatcataagactggcagaaagtctcatgcaactgtcgcgagtccaacaaaaaagcaagcctacttctcaaaaccttttctccaacggagttcgagtgcaaaacctgtaaccgcaagtttccatcttttcaagcccttggtggtcacagggcgagccacaagaagcccaagttcgaaggtgaagaactca

SEQ ID NO: 2424 - DNA, 247 bp, Glycine max
acaacacaacacaaccagatccaacatggtagccattctgaagagacaaagagaaaccgaagccgaggagagcatcataagactggcagaaagtctcatgcaactgtcgcgagtccaacaaaaaagcaagcctcttctcaaaaccttttctccaacggagttcgagtgcaaaacctgtaaccgcaagtttccatcttttcaagcccttggtggtcacagggcgagccacaagaagcacaattcgaag

SEQ ID NO: 2425 - DNA, 270 bp, Glycine max
attcacaacacaaacacattcaacaacatggtagcaattctcaagagacagggagaaaacgaatccgaagaaaccatcataggcttggcaaaaagtctcatgcaactctcgcgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaa

SEQ ID NO: 2426 - DNA, 279 bp, Glycine max
tcttcattcatttattcttattcatcttttcattcactcactctcactcatggctgaagatgggaacaacaacgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcgccaacgcgagctccg

SEQ ID NO: 2427 - DNA, 255 bp, Glycine max
catcttttcattcactcactctcactcatggctgaagatgggaacaacaacgatgtacccttacacaaattcaaagacagcaatccataccctgaagagttcgatgcaaagggttacagcctcagcggaaaaatcatggtttcagcaataatccttcttttcttcgtcgtcgttttgatgttgtgccttcatatctacgcgcgctggtacctccggcgtgctcgccgccgccagctccggcgccaacgcgagctc

SEQ ID NO: 2428 - DNA, 275 bp, Glycine max
gaagatgggaacaacaacgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcgccaacgcgagctccgccgcacccagcttgtcttttacaacgacgacgccacccccgcagccgtgtc

SEQ ID NO: 2429 - DNA, 278 bp, Glycine max
ttttcattcactcactctcactcatggctgaagatgggaacaacaacgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgcggcggcaagctccggggcaacgcgagctcggcggaacccagcttgtcttttaacacg

SEQ ID NO: 2430 - DNA, 276 bp, Glycine max
attcatcttttcattcactcactctcactcatggctgaagatgggaacaacaacgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcgccaacgcgagctccgccgcacccagcttgtc

SEQ ID NO: 2431 - DNA, 297 bp, Glycine max
ttcggctcgagcatggctgcagatgggaacaacaacgatgtacccttacacaaattcaaagacagcaatccaaaccctggagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcgccaacgcgagctccgccgcacccagcttgtcttttacaacgacgacgccacccccgcagccgtgtcagtg

SEQ ID NO: 2432 - DNA, 249 bp, Glycine max
tcttattcatcttttcattcactcactctcactcatggctgaagatgggaacaacaacgatgtacccttacacaaattcaaagacagcaatccaaaccctggagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcg

SEQ ID NO: 2433 - DNA, 378 bp, Glycine max
acaacgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgacagctccggcgccaacgcgagctccgccgcacccagcttgtcttttacaacgacgacgccacccccgcagccgtgtcacgtggcctcgacgccgccatccttgccacgctccccgtcttcaccttcgacccggaaaaaaccgggccggaatgcgctgtttgcttgtcggagttcgaaccccgtgaaacgggtc

SEQ ID NO: 2434 - DNA, 96 bp, Glycine max
  unsure (1)..(96): unsure at all n locations
ctcangggcttactcccatgantggactgagtgtccattcgntcatccaggggagaatgcgaggaggagagacccacggnnatacccttacagctt

SEQ ID NO: 2435 - DNA, 389 bp, Glycine max
ataggcagcgagaagacgacagaaggggaaacaaaaaccatcagcaacataaaggaaaaaaatagaaagaaaaatgatgctcggagaacaccatcgcgggaatccgacggtcctcgtgccaccgtggccagcccacgacgatccgacggctgagatgtactccgcgttcttaacaaacgacgtcaatgctggtgagtactctccgtaccatcttcaagaagcactaacggcgctgcagcgttttctgccgtcaaacgaaacggacgcagactcggactcctcggaggcggctcagcccgacgcggcggtggacgcgtacacgtgcgaccatttccgcatgtacgagttcaaggtccgtcgatgcgcacgtggcaagtcacacgactgga

SEQ ID NO: 2436 - DNA, 416 bp, Glycine max
  unsure (1)..(416): unsure at all n locations
gagccacgcgtcagcccacgcgtccgcccacgcgtccgtacggctgcgagaagacgacagaaggggattgctaaacaaaagaagcatgtctaatcatcatcacgtagttcagacctcgccaccgaaactattcggtttcccactaacagagcaggaggaattgaattcagatgcagaaagaaaatacgaggttggagaggacagaaaattcagatgccactactgcaaacgagtattcggaaactctcaggccttanggggccaccaaaacgcccacaagaaagagcgtcagagggcgaggcgtttccaaatccacactcatagacgctccattgcagcaccaccttctgcttctgttctcaactcacatgcaataataagatcagtancttcagttacagttactacgctaccct

SEQ ID NO: 2437 - DNA, 361 bp, Glycine max
  unsure (1)..(361): unsure at all n locations
cgtgtctaatcatcatcacgtagttcagacctcgccaccgaaactattcggtttcccactaacagagcaggaggaattgaattcagatgcagaaagaaaatacgaggttggagaggacagaaaattcagatgccactactgcaaacgagtattcggaaactctcaggccttatggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctaccctncttcatttacttacgaggaggcccttct

SEQ ID NO: 2438 - DNA, 357 bp, Glycine max
gcaacataaatacttccaatagaacgaaaactgatgctcggagaacaccatcgcgggaatccgacggtcctcatgccaccgtggccagcccactacgatccgacggctgagatgtactccgcgttcgtaacacacgacatcactgctggtgagtactctccgtaccatcttcaggaagcactaacggcgctgcagcgttttctgccgtcaaacgaaacggacgcagactcggactcctcggaggcggctcagcccgacactgcggtggacgcgtacacgtgcgaccatttccgcatgtacgagttcaaggtccgtcgatgcgcacgtggcaagtcacacgactggaccgactgtccg

SEQ ID NO: 2439 - DNA, 395 bp, Glycine max
tacggctgcgagaagacgacagaaggggaaacaaaaaccatcaccaaaaaaagaaaatgatgctcggagagcaccatcgcgcgaatccaacggttcacgtgccaccgtggccaacccacgacgatccaacggccgagatgtactccgcgtttttaacaaacgacgtcaatgctggtgagtactctccgtactatcttcaagaagcactaacggctctgcagcgttttctgccgtctaacgaaacggacgctgactcggacacggaggctcaacccgacgcggcggtggacgcgtactcgtgcgaccatttccgcatgtacgagttcaaggtccgtcgatgcgcacgtggcaggtcacacgactggacggagtgtccgtacgcgcatcccggcgag

SEQ ID NO: 2440 - DNA, 413 bp, Glycine max
agtacggctgcgagaagacgacagaaggggaaacaaaaaccatcagcaacataaaaaaaaaaaaatatagaaagaaaaatgatgctcggagaacaccatcgcgggaatccgacggtcctcgtgccaccgtggccagcccacgacgatccgacggctgagatgtactccgcgttcttaacaaacgacgtcaatgctggtgagtactctccgtaccatcttcaagaagcactaacggcgctgcagcgttttctgccgtcaaacgaaacggacgcagactcggactcctcggaggcggctcagcccgacgcggcggtggacgcgtacacgtgcgaccatttccgcatgtacgagttcaaggtccgtcgatgcgcacgtggcaggtcacacgactggacggagtgtccgtacgcgca

SEQ ID NO: 2441 - DNA, 395 bp, Glycine max
tacggctgcgagaagacgacagaagggggtaaacaaagaccatcaccaaaaaagaaaatgatgctcggagagcaccatcgcgcgaatccaacggttcacgtgccaccgtggccaacccacgacgattcaacggccgagatgtactccgcgtttttaacaaacgacgtcaatgctggtgagtactccccgtactatcttcaagaagcactaacggctctgcagcgttttctgccgtctaacgaaacggacgctgactcggacacggaggctcaacccgacgcggcggtggacgcgtactcgtgcgaccatttccgcatgtacgagttcaaggtccgtcgatgcgcacgtggcaggtcacacgactggacggagtgtccgtacgcgcatcccggcga

SEQ ID NO: 2442 - DNA, 428 bp, Glycine max
  unsure (1)..(428): unsure at all n locations
tacggctgcgagaagacgacagaagggggtaaacaaaaaccatcaccanaaaagaaaatgatgctcggagagcaccatcgcgcgaatccaacggttcacgtgccaccgtggccaacccacgacgatccaacggccgagatgtactccgcgtttttaacaaacgacgtcaatgctggtgagtactctccgtactatcttcaagaagcactaacggctctgcagcgttttctgccgtctaacgaaacggacgctgactcggacacggaggctcaacccgacgcggcggtggacgcgtactcgtgcgaccatttccgcatgtacgagttcaaggtccgtcgatgcgcacgtggcaggtcacacgactggacggagtgtccgtacgcgcatcccggcgagaaggctcgacgccgggacccgagaaagttcac

SEQ ID NO: 2443 - DNA, 108 bp, Glycine max
cacggcgttttcgagtgctggctccacccggcgcgctatcggactcagccttgcaaggacggcacgagttaccggcgacgggtgtgcttcttcgcgcacacgccggag

SEQ ID NO: 2444 - DNA, 270 bp, Glycine max
  unsure (1)..(270): unsure at all n locations
cttgacgccgggacccgagaaagttccactactccggcgcggcgtgcccggagtttccgcaagggaaactgcaagaaaggcgacacgtgcgagtncgcgcacggcgttttcnagtgctggctccacccggcgcgctatcggaannagccttgcaaggacggcacgagttgccggccgcgggtgtgcttcttcgcgcacacgccggagcagtgcgcgtcttgccgatgcagagtccggtagccggcgaattctctgagtcttacgatggtt

SEQ ID NO: 2445 - DNA, 261 bp, Glycine max
tctttttactgcttaaccgttcggctatctcatatatgaacaacaacatgttaggaatgaagagacggagagatgataatgaagggtccttggatttggcaaaatgtcttatgctgttttcttgtccaatagaaagcaacaagacacaacagaaaagttttggttctgtggaatttgagtgcaagacgtgcaaccgcaagttctcttcttttcaagcactgggagggcacagggcaagccacaagaggcagaagctggagg

SEQ ID NO: 2446 - DNA, 249 bp, Glycine max
gaatcctcgagatttctttcgattgaactcatttctctcttcttcgccacgcaatcttgtctctgtaagcggtgattttggttctggacaatgtctcgtgtttatgttgggaatttagaccctcgagtcagtgagagggacctcgaagatgaatttcgtatatatggtgttctaggagtgtctgggttgctcgaagaccaccgggatatgcatttattgagtttgatgataggagggatgcacttgatg

SEQ ID NO: 2447 - DNA, 261 bp, Glycine max
ggtgattttggttctggacaatgtctcgtgtttatgttgggaatttagaccctcgagtcagtgagagggacctcgaagatgaatttcgtatatatggtgttcttaggagtgtctgggttgctcgaagaccaccgggatatgcatttattgagtttgatgataggagggatgcacttgatgcaattcaggccttggatgaaaaaatggttggcgtgtagagctttctcataattccaagggtggtggccgaggagggcgtgg

SEQ ID NO: 2448 - DNA, 279 bp, Glycine max
gctgctgttgcaaaacttagggttgggcctttttttgaggttttcagcgcttctttctcacaatggttcttcagaatgatattgatttgctgaatcctccagctgagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaaccaacagggggacggg

SEQ ID NO: 2449 - DNA, 281 bp, Glycine max
ctccttctcccgccgcaactcacactgtcttccttctctagggtttttagctcctccaaattcttcgcccaacatggttcttcaaaatgatattgatttgctaaatcccccggctgagcttgagaagaggaaacacaagctcaagcgtcttgttcagtcaccaaactctttcttcatggatgttaagtgccagggttgcttcaacataaccactgtctttagccactctcagactgttgttgtatgcggaaatgccagaccgtcttgtgccagccgacagg

SEQ ID NO: 2450 - DNA, 291 bp, Glycine max
cttcatttcttccctcgccgctttgtgctgctgctgctgcaaaacctagggttgagccttttgctcaggttttcagcgcttctttcttacaatggttctacagaacgatattgatttgctgaatcctccagctgagttggagaagagaagcccagctccaagcgtcttgtgcagtcaccaaactctttcttcatggatgttaagtgccagggctgcttcaacataacaactgtgtttagccactctcagactgttgtggtttgcggaaactgccagactgtgttgtgccaa

SEQ ID NO: 2451 - DNA, 266 bp, Glycine max
  unsure (1)..(266): unsure at all n locations
gctgctgctgctgcaaaacctagggttgagccttttgctcaggttttcagcgcttctttcttacaatggttctacagaacgatattgatttgctgaatcctccagctgagttggagaagngaaagcacaagctcaagcgtcttgtgcagtcaccaaactctttcttcatggatgttaagtgccagggctgcttcaanaaaacnttgtgttnnncccccccnganntnnngggnttngggaaacgnccaancgtgttgccccaccaa

SEQ ID NO: 2452 - DNA, 249 bp, Glycine max
  unsure (1)..(249): unsure at all n locations
gaggaaacacaagctcaagcgtcttgttcagtcaccaaactctttcttcatggatgttaagtgccagggttgcttcaacataaccactgtctttagccactctcagactgttgttgtatgcggaaactgccagactgtcttgtgtcaaccaaccggtggccgggcaaggctaaccgagggatgcccttaggaagaagggagactnantggatgccatcttttttgtttgtgatggagagtttcagtaat

SEQ ID NO: 2453 - DNA, 260 bp, Glycine max
cccgccgcaactcacactgtcttccttctctagggtttttagctcctccaaattcttcgcccaacatggttcttcaaaatgatattgatttgctaaatcccccggctgagcttgagaagaggaaacacaagctcaagcgtcttgttcagtcaccaaactctttcttcatggatgttaagtgccagggttgcttcaacataaccactgtctttagccactctcagactgttgttgtatgcggaaattgccagaccgtcttg

SEQ ID NO: 2454 - DNA, 328 bp, Glycine max
  unsure (1)..(328): unsure at all n locations
ctgctgcaaaacctagggttgagccttttgctcaggttttcagngcttctttcttacaatggttctacagaacgatattgatttgctgaatcctccagctgagttggagaagagaaagcacaagctcaagcgtcttgtgcagtcaccaaactctttcttcatggatgttaagtgccagggctgcttcaacataacaactgtgtttagccactctcagactgttgtggtttgcggaaactgccagactgtgttgtgccaaccaacaggcggangncaaggtaacccgggggtnctttttaggaaagaggggttttgnntgttttccanc

SEQ ID NO: 2455 - DNA, 248 bp, Glycine max
aaaacttagggttgggcctttttttgaggttttcagcgcttctttctcacaatggttcttcagaatgatattgatttgctgaatcctccagctgagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgttttgtg

SEQ ID NO: 2456 - DNA, 186 bp, Glycine max
gtcaccaaactctttcttcatggatgttaagtgccagggttgcttcaacataaccactgtctttagccactctcagactgttgttgtatgcggaaactgccagactgtcttgtgtcaaccaaccggtggccgggcaaggctaactgagggatgctcctttaggaagaagggagactgagtggattg

SEQ ID NO: 2457 - DNA, 263 bp, Glycine max
tcccgccgcaactcacactgtcttccttctctagggtttttagctcctccaaattcttcgcccaacatggttcttcaaaatgatattgatttgctaaatcccccggctgagcttgagaagaggaaacacaagctcaagcgtttgttcagtcaccaaactctttcttcatggatgttaagtgccagggttgcttcaacataaccactgtctttagccactctcagactgttgttgtatgcggaaattgccagaccgtcttgtgc

SEQ ID NO: 2458 - DNA, 257 bp, Glycine max
cccgccgcaactcacactgtcttccttctctagggtttttagctcctccaaattcttcgcccaacatggttcttcaaaatgatattgatttgctaaatcccccggctgagcttgagaagaggaaacacaagctcaagcgtcttgttcagtcaccaaactctttcttcatggatgttaagtgccagggttgcttcaacataaccactgtctttagccactctcagactgttgttgtatgcggaaattgccagaccgtc

SEQ ID NO: 2459 - DNA, 223 bp, Glycine max
gaggaaacacaagctcaagcgtcttgttcagtcaccaaactcttgcttcatggatgttaagtgccagggttgcttcaacataaccactgtatttagccactctcagactgttgttgtatgcggaaactgccagactgtcttgtgtcaaccaaccggtggccgggcaaggctaaccgagggatgctcctttaggaagaagggagactgagttgattgccatctt

SEQ ID NO: 2460 - DNA, 247 bp, Glycine max
gaggaaacacaagctcaagcgtcttgttcagtcaccaaactctttcttcatggatgttaagtgccagggttgcttcaacataaccactgtctttagccactctcagactgttgttgtatgcggaaactgccagactgtcttgtgtcaaccaaccggtggccgggcaaggctaaccgagggatgctcctttaggaagaagggagactgagtggattgccatctttttttgtttgtgattggagagttt

SEQ ID NO: 2461 - DNA, 264 bp, Glycine max
gtcgcaactcacactgtgtcgcttctctagggtttttagctcctccagattcttcgcccaacatggttcttcaaaatgacattgattagctcaaatctacccggctgagacttgacttgagggtacacatagctgcaatgcgtcttgttgagacagtaaactgctttcttcatggatgttaagtgccagggttgcttcaacataaccactgtctttagccactctcagactgttgttgtatgcggtaattgccagaccgtcttg

SEQ ID NO: 2462 - DNA, 258 bp, Glycine max
tctcccgacgcaactcactgtcttccttctctagggtttttagctcccccaatttcttcgctcaacatggttcttcaaaatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgttgtatgcggaaactgccagactgtc

SEQ ID NO: 2463 - DNA, 259 bp, Glycine max
atgttgcaaaacttagggttgagcatttttttgaggttttcagcgcttctttgtcacaatggttcttcagaatgatattgatttgctgaatcctccagctgagttggagaagagaaaacacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaa

SEQ ID NO: 2464 - DNA, 272 bp, Glycine max
gctgctgcaaaacctagggttgagccttttgctcaggttttcagcgcttctttcttacaatggttctacagaacgatattgatttgctgaatcctccagctgagttggagaagagaaagcacaacccaagcgtcttgtgcagtcaccaaactctttcttcatggatgttaagtgccagggctgcttcaacataacaactgtgtttagccactctcagactgttgtggtttgcggaaactgccagactgtgttgtgccaaccaacaggcggac

SEQ ID NO: 2465 - DNA, 254 bp, Glycine max
gcaaaacttagggttgggcctttttttgaggttttcagcgcttctttctcacaatggttcttcagaatgatattgatttgctgaatcctccagctgagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaa

SEQ ID NO: 2466 - DNA, 257 bp, Glycine max
acttagggttgggcctttttttgaggttttcagcgcttctttctcacaatggttcttcagaatgatattgatttgctgaatcctccagctgagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgttttgtgaccaaccaacag

SEQ ID NO: 2467 - DNA, 255 bp, Glycine max
cactgtcttccttctctagggtttttagctcctccaaattcttcgcccaacatggttcttcaaaatgatattgatttgctaaatcccccggctgagcttgagaagaggaaacacaagctcaagcgtcttgttcagtcaccaaactctttcttcatggatgttaagtgccagggttgcttcaacataaccactgtctttagccactctcagactgttgttgtatgcggaaattgccagaccgtcttgtgccagccg

SEQ ID NO: 2468 - DNA, 295 bp, Glycine max
  unsure (1)..(295): unsure at all n locations
cttctcccgccggcaacttcacactgtcttcctttctctagggttttanagctcctccaaattcnttcgcccaacatggttcttcaaaatgatattgatttgctaaatcccccggctgagcttgagaagaggaaacacaagctcaagcgtcttgttcagtcaccaaactctttcttcatggatgttaagtgccagggtgcttcaacataaccactgtctttagccactctcagactgttgttgtatgcggaaattgccagaccgtcttgtgccagccgacagcggccgggcaang

SEQ ID NO: 2469 - DNA, 264 bp, Glycine max
ctttgtgctgctgctgctgcaaaacctagggttgagccttttactcaggttttcagcgcttctttcttacaatggttctacagaacgatattgatttgctgaatcctccagctgagttggagaagagaaagcacaagctcaagcgtcttgtgcagtcaccaaactctttcttcatggatgttaagtgccagggctgcttcaacataacaactgtgtttagccactctcagactgttgtggtttgcggaaactgccagactgtgt

SEQ ID NO: 2470 - DNA, 284 bp, Glycine max
ccctcgccgctttgtgctgctgctgctgcaaaacctagggttgagccttttgctcaggttttcagcgcttctttcttacaatggttctacagaacgatattgatttgctgaatcctccagctgagttggagaagagaaagcacaagctcaagcgtcttgtgcagtcaccaaactctttcttcatggatgttaagtgccagggctgcttcaacataacaactgtgtttagccactctcagactgttgtggtttgcggaaactgccagactgtgttgtgccaacca

SEQ ID NO: 2471 - DNA, 273 bp, Glycine max
tgctgctgttgcaaaacttagggttgggcctttttttgaggttttcagcgcttctttctcacaatggttcttcagaatgatattgatttgctgaatcctccagctgagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaaccaacaggg

SEQ ID NO: 2472 - DNA, 274 bp, Glycine max
gcaactcactgtcttccttctctagggtttttagctcccccaatttcttcgctcaacatggttcttcaaaatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgttgtatgcggaaactgccagactgtcttgtgtcaaccaacggtggccgggc

SEQ ID NO: 2473 - DNA, 255 bp, Glycine max
ctcactgtcttccttctctagggtttttagctcccccaatttcttcgctcaacatggttcttcaaaatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgtgtatgcggaaactgccagactgtcttgtgtcaacc

SEQ ID NO: 2474 - DNA, 266 bp, Glycine max
gcaaaacttagggttgagcctttttttgaggttttcagcgcttctttctcacaatggttcttcagaatgatattgatttgctgaatcctccagctgagttggagaagagaaaacacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaaccaacaggggga

SEQ ID NO: 2475 - DNA, 237 bp, Glycine max
gcaactcacactgtcttccttctctagggtttttagctcctccaaattcttcgcccaacatggttcttcaaaatgatattgatttgctaaatcccccggctgagcttgagaagaggaaacacaagctcaagcgtcttgttcagtcaccaaactctttcttcatggatgttaagtgccagggttgcttcaacataaccactgtctttagccactctcagactgttgttgtatgcggaa

SEQ ID NO: 2476 - DNA, 260 bp, Glycine max
gctgctgctgctgcaaaacctagggttgagccttttgctcaggttttcagcgcttctttcttacaatggttctacagaacgatattgatttgctgaatcctccagctgagttggagaagagaaagcacaagctcaagcgtcttgtgcagtcaccaaactctttcttcatggatgttaagtgccagggctgcttcaacataacaactgtgtttagccactctcagactgttgtggtttgcggaaactgccagactgtgttg

SEQ ID NO: 2477 - DNA, 269 bp, Glycine max
tatcgagccgaatcggctcgacgctgctgttgcaaaacttagggtatgagcctttttttgagagttttcagcgcttctttctacacaatggttcttcagaatgatattgatttgctgaatcctccagctgagttggagaagagaaaacacaaactcaagcgtcttgttcagtcaccaaactctttcttcatggatgttaagtgccagggatgcttcaacataacaactgtgtttagccactctcaaactgttgtggtgtgcggaaactg

SEQ ID NO: 2478 - DNA, 284 bp, Glycine max
agctgctgttgcaaaacttagggttgagcctttttttgaggttttcagcgcttctttctcacaatggttcttcagaatgatattgatttgctgaatcctccagctgagttggagaagagaaaacacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaaccaacagggggacgggcgag

SEQ ID NO: 2479 - DNA, 262 bp, Glycine max
accgcaactcacactgtcttccttctctagggtttttagctcctccaaattcttcgcccaacatggttcttcaaaatgatattgatttgctaaatcccccggctgagcttgagaagaggaaacacaagctcaagcgtcttgttcagtcaccaaactctttcttcatggatgttaagtgccagggttgcttcaacataaccactgtctttagccactctcagactgttgttgtatgcggaaattgccagaccgtcttgtgcca

SEQ ID NO: 2480 - DNA, 271 bp, Glycine max
agttttcagcggctttttgtcacaatggtgcttcaaaacgatattgatttgctgaatcctcctgctgaattggagaagagaaagcacaagcttaagcgtcttgttcaatcaccaaattcgttcttcatggatgtcaagtgccagggctgcttcaacataacaactgtgtttagccactcccagacagttgtagtatgtggtaactgccagactgtgttgtgccaaccaacgggtggacgggcgaggttaaccgaagggtgctcttttagga

SEQ ID NO: 2481 - DNA, 268 bp, Glycine max
tgctgctgctgctgcaaaacctagggttgagccttttgctcaggttttcagcgcttctttcttacaatggttctacagaacgatattgatttgctgaatcctccagctgagttggagaagagaaagcacaagcgcaagcggcttgtgcagtcaccaaactctttcttcatggatgttaagtgccagggctgcttcaacataacaactgtgtttagccactctcagactgttgtggtttgcggaaactgccagactgtgttgtgccaac

SEQ ID NO: 2482 - DNA, 260 bp, Glycine max
cgctttgtgctgctgctgctgcaaaacctagggttgagccttttgctcaggttttcagcgcttctttcttacaatggttctacagaacgatattgatttgctgaatcctccagctgagttggagaagagaaagcacaagctcaagcgtcttgtgcagtcaccaaactctttcttcatggatgttaagtgccagggctgcttcaacataacaactgtgtttagccactctcagactgttgtggtttgcggaaactgccaga

SEQ ID NO: 2483 - DNA, 275 bp, Glycine max
cttctcccgccgcaactcactgtcttccttctctagggtttttagctcccccaatttcttcgctcaacatggttcttcaaaatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgttgtatgcggaaactgccagactgtcttgtgtcaaccaacc

SEQ ID NO: 2484 - DNA, 232 bp, Glycine max
gggtttttagctcccccaatttcttcgctcaacatggttcttcaaaatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgttgtatgcggaaactgccagactgtcttgtgtc

SEQ ID NO: 2485 - DNA, 247 bp, Glycine max
tgcaaacttagggttgggacttttgttgaggttttcagcgcttctttctcacaatggttcttcagaatgatattgatttgctgaatcctccagctgagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgtttt

SEQ ID NO: 2486 - DNA, 263 bp, Glycine max
aatttcttcgctcaacatggttcttcataatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgttgtatgcggaaactgccacactgtcttgtgtcaaccaaccggtggccgggcaaggctaaccgagggatgctcctttagga

SEQ ID NO: 2487 - DNA, 287 bp, Glycine max
atacggctgcgagaagacgacagaagggggccgctttgtgctgctgttgcaaaacttagggttgggcctttttttgaggttttcagcgcttctttctcacaatggttcttcagaatgatattgatttgctgaatcctcaagctgagttggagtagagaaagcacaaactcaggcgtcttgttcagtcaccaaactctttcttcatggatgttaagtgccagggatgcttcaacataacaactgtgtttagccactctcaaactgttgtggtgtgcggaaactgccag

SEQ ID NO: 2488 - DNA, 284 bp, Glycine max
acggctgcgagaagacgacagaagggggccgctttgtgctgctgttgcaaaacttagggttgggcctttttttgaggttttcagcgcttctttctcacaatggttcttcagaatgatattgatttgctgaatcctccagctgagatagagaagagaaagcacaaactcaagcgtcttgttcagtcaccaaactctttcttcatggatgttaagtgccagggatgcttcaacataacaactgtgtttagccactctcaaactgttgtggtgtgcggaaactgcca

SEQ ID NO: 2489 - DNA, 246 bp, Glycine max
ataaagcacaagctcaagcgtcttgtgcagtcaccaaactctttcttcatggatgttaagtgccagggctgcttcaacataacaactgtgtttagccactctcagactgttgtggtttgcggaaactgccagactgtgttgtgccaaccaacaggcggacgggcaaggttaaccgaagggtgctcttttaggaagaagggagattgaatggtttgttaaccagacttttctttgtcaatgattgaa

SEQ ID NO: 2490 - DNA, 243 bp, Glycine max
agaaagcacaagctcaagcgtcttgttcagtcaccaaactctttcttcatggatgttaagtgccagggctgcttcaacataacaactgtgtttagccactctcagactgttgtggtttgcggaaactgccagactgtgttgtgccaaccaacaggcggacgggcaaggttaaccgaaggtgctcttttaggaagaagggagattgaatggtttgttaaccagacttttctttgtcaatgattg

SEQ ID NO: 2491 - DNA, 214 bp, Glycine max
tgctgttgcaaaacttagggttgggcctttttttgaggttttcagcgcttctttctcacaatggttcttcagaatgatattgatttgctgaatcctccagctgagttggagaagagaaagcacaaactcaagcgtcttgttcagtcatcaaactccttcttcagggatgtcaagtgccagggatgccttcaccataacaaccggggtttaagcc

SEQ ID NO: 2492 - DNA, 272 bp, Glycine max
aatcgagccgagtcggctcgagctgctcgagactgtcttccttgtatctgggtttttaggtcactcgatttcttcgctcaacattgttcttgaaaatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgttgtatgcggaaactgccagactg

SEQ ID NO: 2493 - DNA, 261 bp, Glycine max
gctgctgttgcaaaacttagggttgggcctttttttgaggttttcagcgcttctttctcacaatggttcttcagaatgatattgatttgctgaatcctccagcagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaa

SEQ ID NO: 2494 - DNA, 395 bp, Glycine max
ctgtcttccttctctagggtttttagctcccccaatttctgcgctcaacatggttcttcaaaatgatattgatttgctaaatcctccggttgagcttgagaagaggaaacacaagctcaagcgtcttgttcagtcaccaaactctttcttcatggatgttaagtgccagggttgcttcaacataaccactgtctttagccactctcagactgttgttgtatgcggaaactgccagactgtcttgtgtcaaccaaccggtggccgggcaaggctaaccgagggatgctcctttaggaagaagggagactgagtggattgccatctttttttgtttgtgattggagagtttcagtaatgccttcttttgttttgggtatgatgaatatgtaattttg

SEQ ID NO: 2495 - DNA, 391 bp, Glycine max
caaaacttatggttgagcctttttttgaggttttcagcgctgctttctcacaatggttcttcagaatgatattgatttgctgaatcctccagctgagttggagaagagaaaacacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaaccaacagggggacgggcgaggttaaccgaaggttgctcatttaggaagaagggagattgaatggtttgttaaccagacttttctttgtcaatgatttgagattttcggttgttaggtttttgagatggaatcaatttc

SEQ ID NO: 2496 - DNA, 418 bp, Glycine max
  unsure (1)..(418): unsure at all n locations
acccacgcgtccgcccacgcgtccgcccacgcgtccgacggctgcgagaagacgacagaaggggcttccctcgccgctttgtgctgctgctgctgcaaaacctagggttgagccttttgctcaggttttcagcgcttctttcttacaatggttctacagaacgatattgatttgctgaatcctccagctgagttggagaagagaaagcacaagctcaagcgtcttgtgcagtcaccaaactctttcttcatggatgttaagtgccagggctgcttcaacataacaactgtgtttagccactctcagactgttgtggtttgcggaaactgccagactgtgttgtgccaaccaacaggcggacgggcaaggttaaccgaanggtgctcttttangaagaagggagattgaatggtttgtt

SEQ ID NO: 2497 - DNA, 299 bp, Glycine max
gctttctcgccgctttgtgctgctgttgcaaaacttagggttgagcctttttttgaggttttcagcgcttctttctcacaatggttcttcagaatgatattgatttgctgaatcctccagctgagttggagaagagaaaacacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaaccaacggggggacgggcg

SEQ ID NO: 2498 - DNA, 265 bp, Glycine max
gagaattacaactgaaattaaattgctatctgaagatgcttctaagccctctgccacttgcaattatcaagaagctatttccatatataaaaggattgagaagctgcaaacagaactctttcatcctttatcaatcaacttgatgcatactagggagaagattttgaagtcactaatggagctggaacactggacagaagctttagcatattgcaaattgaccataccattctatcaaagagtgtatccagctgttcaccctctg

SEQ ID NO: 2499 - DNA, 260 bp, Glycine max
  unsure (1)..(260): unsure at all n locations
gatgatcccaaacgttcaaatccctacctgggacgcggacggaggaggagcactctccccgtcgatctcttccaatgctgacacgtgctcattattctcctccgaccatttccgaatgttccagttcaaggtgcggaactgtccacgtgtcaggtcccacgactggaccgagtgtccctacgcccaccccgccgagaaggctcgccgccgtgacccccgcacgtacncatactcaggcacctcctgccccgattaccgga

SEQ ID NO: 2500 - DNA, 258 bp, Glycine max
cccaaacgttcaaatccctacctgggacgcggacggaggaggagcactctccccgtcgatctcttccaatgctgacacgtgctcattattctcctccgaccatttccgaatgttccagttcaaggtgcggaactgtccacgtggcaggtcccacgactggaccgagtgtccctacgcccaccccgccgagaaggctcgccgccgtgacccgcgcaagtaccactactcaggcacctcctgccccgattaccggaaggg

SEQ ID NO: 2501 - DNA, 252 bp, Glycine max
  unsure (1)..(252): unsure at all n locations
acttcnnnnnnnncnnnctnngncgcggacggaggaggagcactctccccgtcgatctcttccaatgctgacacgtgctcattattctcctccgaccatttccgaatgttccagttcaaggtgcggaactgtccacgtggcaggtcccacgactggaccgagtgtccctacgcccaccccgccgagaaggctcgccgccgtgacccccgcaagtaccactactcaggcacctcctgccccgattaccggaag

SEQ ID NO: 2502 - DNA, 434 bp, Glycine max
agtacggctgcgagaagacgcagaagggggaaccactaaacgatgatcccaaacgttcaaatccctacctgggacgcggacggaggaggagcactctccccgtcgatctcttccaatgctgacacgtgctcattattctcctccgaccatttccgaatgttccagttcaaggtgcggaactgtccacgtggcaggtcccacgactggaccgagtgtccctacgcccaccccgccgagaaggctcgccgccgtgacccccgcaagtaccactactcaggcacctcctgccccgattaccggaaggggaactgcaagaggggcgacacgtgtcagttcgcgcaaggggtcctccaatgcgtggttcaacccttctcgctaccggacccagctctgcaaagacggaacaaattgccgccgcagagtgtgcttcttcg

SEQ ID NO: 2503 - DNA, 415 bp, Glycine max
acgtacggctgcgagaagacgacagaagggggaaccactaaacgatgatcccaaacgttcaaatccctacctgggacgcggacggaggaggagcactctccccgtcgatctcttccaatgctgacacgtgctcattattctcctccgaccatttccgaatgttccagttcaaggtgcggaactgtccacgtggcaggtcccacgactggaccgagtgtccctacgcccaccccgccgagaaggctcgccgccgtgacccccgcaagtaccactactcaggcacctcctgccccgattaccggaaggggaactgcaagaggggcgacacgtgtcagttcgcgcacggcgtcttcgaatgctggctccacccttctcgctaccggacccagctctgcaaagacggaacaaattgccg

SEQ ID NO: 2504 - DNA, 410 bp, Glycine max
acggggagccactaaacgatgatcccaagcgttcaaatccctacctgggacgcggacggaggaggagcactctccccgtcgatctcttccaatgctgacacgtgctcattattctcctccgaccatttccgaatgttccagttcaaggtgcggaactgtccacgtggcaggtcccacgactggaccgagtgtccctacgcccaccccgccgagaaggctcgccgccgtgacccccgcaagtaccactactcaggcacctcctgccccgattaccggaaggggaactgcaagaggggcgacacgtgtcagttcgcgcacggcgtcttcgaatgctggctccacccttctcgctaccggacccagctctgcaaagacggaacacatttgcgccgcagagtgtgcttcttcgc

SEQ ID NO: 2505 - DNA, 445 bp, Glycine max
ggaacatcaagttgggttccaaaggctgtgtagtcatcttcatcggacaagcgtgcggggagctcacaacaaaagaatctgccctctcttgaaaatgatgttggtcaatccagtactagtagtgttataccatctgaacatttgttctgtgcatttgctgctgccaactgcccccttgaagataaatgttctcgcattcatggaaatcagtgcttatactgtagaaaattatgcttacatcctactgatcgaaaggaaaaagaaaaccatttgagaacttgtgagaaaaaggaaaaataccttcaggctttgaaagatagtcaagacgtagagtgcaatgtttgtttggaacgtgttctgtccaaacctaaaccagctgattgtaggtttggtctgcttcctgaatgtgaccatgctttctgtttatcctgtatccgcaattggc

SEQ ID NO: 2506 - DNA, 263 bp, Glycine max
gaaaaacttagagtggtagttgtaggaaagcaagaacagtgaagtgttctcctaattcagtgagtgaggttctgaattctttaacttgagatgatggcatcatttgcagggactactcagaagtgcaaagcatgtgagaagactgtgtatttggtggatcagctcactgctgacaacaagatctatcacaaatcatgtttcagctgctaccactgcacaggtacccttaagttgagtaatattgttcctttgagggtgtgtta

SEQ ID NO: 2507 - DNA, 273 bp, Glycine max
cacaactaaaaaaaagaagaaaaacttagagtggtagttgtaggaaagcaagaacagtgaagtgttctcctaattcagtgagtgaggttctgaattctttaacttgagatgatggcatcatttgcagggactactcagaagtgcaaagcatgtgagaagactgtgtatttggtggatcagctcactgctgacaacaagatctatcacaaatcatgtttcagatgctaccactgcaagggtacccttaagttgagtaactattgttcctttgag

SEQ ID NO: 2508 - DNA, 263 bp, Glycine max
  unsure (1)..(263): unsure at all n locations
gaaaaacttagagtggtagttgtaggaaagcaagaacagtgaagtgttctcctaattcagtgagtgaggttctgaattcttcaacttgagatgatggcatcatttgcagggactactcagaagtgcanagcatgtgagaagactgtgtatttggtggatcagctcactgctgacaacaagatctatcacaaatcatgtttcagatgctaccactgcaagggtaccttaagttgagtaactattgttccttcgagggtgtgtta

SEQ ID NO: 2509 - DNA, 283 bp, Glycine max
tacggctgcgagaagacgacagaagggggagatgatggcatcatttgcagggactactcagaagtgcaaagcatgtgagaagactgtgtatttggtggatcagctcactgctgacaacaagatctatcacaaatcatgtttcagatgctaccactgcaagggtacccttaagttgagtaattattgtccctttaagggtgtttaatactgtaagcctcattttgatcaactctttaagagactggcaactttgacaaagttttgaagtattccagaactgcag

SEQ ID NO: 2510 - DNA, 275 bp, Glycine max
atcgtggtgaacaagtgaggcgcacattgcagatttgagggaggcacgctatagattagaagggaaagactgctacctgtttaagataagtgaagaagtggtggtagatgccactgataaagggaatatagctcggctgattaatcattcttgtatgccaaattgctatgccaggatcatgagtgttggtgacgacgagagccggattgtactcattgctaagactaacgtggttgccggtgatgagttaacgtatgactacttgtttgatcctg

SEQ ID NO: 2511 - DNA, 176 bp, Glycine max
aaagactgctacctgtttaagattagtgaagaagtggtggtagatgccactgataaagggaatatagctcggctgattaatcattcttgtatgccaaattgctatgcaaggatcatgagtgtcggtgatgaggagatccggattgtactcatcgctaagactaacgtggctgccgg

SEQ ID NO: 2512 - DNA, 266 bp, Glycine max
tgagaattttgctgagtctcaacttgttcccaagatgccaaaacaagcttctgaagagcctaagaagaaaaagaaagtgaagctgccacttccattagttccagctgataacaatcaaaatgcctcacaacctgttaggcaatgcatgcattgtgagataaccaagacaccacagtggagggcagggccaatgggaccaaaaacactatgcaatgcttgtggtgttcgttacaagtccggccggctcttccccgagtaccggcctg

SEQ ID NO: 2513 - DNA, 263 bp, Glycine max
gccaaaacaagcttctgaggagcctaagaagaaaaagaaagtgaagctgccacttccattagttccagctgataacaatcaaaatgcctcacaacctgttaggaaatgcatgcattgtgagataaccaagacaccacagtggagggcagggccaatgggaccaaaaacactatgcaatgcttgtggtgttcgttacaagtccggccggctcttccccgagtaccggcctgctgcaagtccaactttttgcccatctgtgcact

SEQ ID NO: 2514 - DNA, 267 bp, Glycine max
gaaactctttatatatttattattgttactgacccaaacaaactcaacaaaaccatgatcccaaacgttgaaatccctcactgggacgccgacggaggaggaccactctctccgttcatctcttcttcttccaatgctgacaagtgctcattattattctcctccgaccatttccgaatgttccagttcaaggtccggatctgtccacgtggcaggtcccacgattggacggagtgtccctacgcccaccctgccgagaaggctcgc

SEQ ID NO: 2515 - DNA, 220 bp, Glycine max
cgatcccaaacgttgaaatccctcactgggacgccgacggaggaggaccactctctccgttcatctcttcttcttccaatgctgacaagtgctcattattattctcctccgaccatttccgaatgttccagttcaaggtccggatctgtccacgtggcaggtcccacgattggacggagtgtccctacgcccaccctgccgagaaggctcgccgccgtga

SEQ ID NO: 2516 - DNA, 265 bp, Glycine max
atcccaaacgttgaaatccctcactgggacgccgacggaggaggaccactctctccgttcatctcttcttcttccaatgctgacaagtgctcattattattctcctccgaccatttccgaatgttccagttcaaggtccggatctgtccacgtggcaggtcccacgattggacggagtgtccctacgcccaccctgccgagaaggctcgccgccgtgacccccgcaagtaccactactccggcaccgcctgccccgattaccaga

SEQ ID NO: 2517 - DNA, 257 bp, Glycine max
atcccaaacgttgaaatccctcactgggacgccgacggaggaggaccactctctccgttcatctcttcttcttccaatgctgacaagtgctcattattattctcctccgaccatttccgaatgttccagttcaaggtccggatctgtccacgtggcaggtcccacgattggacggagtgtccctacgcccaccctgccgagaaggctcgccgccgtgacccccgcaagtaccactactccggcaccgcctgccccga

SEQ ID NO: 2518 - DNA, 438 bp, Glycine max
acggacccatccatgacggctgcgcacacgtcagtgcagcggggagaagacgacagaagggcactctctccgttcatctcttcttcttccaatgctgacaagtgctcattattattctcctccgaccatttccgaatgttccagttcaaggtccggatctgtccacgtggcaggtcccacgattggacggagtgtccctacgcccaccctgccgagaaggctcgccgccgtgacccccgcaagtaccactactccggcaccgcctgccccgattaccagaaggggaactgcaagaggggcgacacttgtcagttctcgcacggcgtcttcgaatgctggctccatccttctcgctaccggacccacctctgcaaagacggaaccacttgccgccgcagagtctgcttcttcgctcacaccaccgaacaactccgcctc

SEQ ID NO: 2519 - DNA, 265 bp, Glycine max
ctcctcagagccaaagctgttctcttttttcatctgggtctacagaaccactggtgaccaaaattgtgaaaaggggttccttgattttcaccaattcatggcatttcagcactacatttcccgggatttgaaaaccatcccaaatgctgtgactgaggcagaaaaccccaatggttgttttgattgtaacatctgcttagactttgcacatgagccagtggtgacactttgtggtcacctctactgctggccatgcatctacaag

SEQ ID NO: 2520 - DNA, 262 bp, Glycine max
aactcctcagagccaaagctgttctcttttttcatctgggtctaaagaaccactggtgaccaaaattgtgaaaaggggttccttgtattttcaccaattcatggcatttcagcactacatttcccgggatttgaaaaccatcccaaatgctgtgactgaggcagaaaaccccaatggttgttttgattgtaacatctgcttagactttgcacatgagccagtggtgacactttgtggtcacctctactgctggccatgcatc

SEQ ID NO: 2521 - DNA, 266 bp, Glycine max
aactcctcagagccaaagctgttctcttttttcatctgggtctaaagaaccactggtgaccaaaattgtgaaaaggggttccttgattttcaccaattcatggcatttcagcactacatttcccgggatttgaaaaccatcccaaatgctggactgaggcagaaaaccccaatggttgttttgattgtaacatctgcttagactttgcacatgagccagtggtgacactttgtggtcacctctactgctggccatgcatctacaag

SEQ ID NO: 2522 - DNA, 249 bp, Glycine max
actcgagccgaatcggctcgactcaccgtgaaaagccgcgagacaggtttcgtttcgtaccgttcagttcacacattcacttctcaatcgattcctcttccctttttctcaatccactacaccacagttacgaggagccaacttgtgtgtaatgggtgtaggagcatcttggtttaccctagaggagcaaccaatttttgctgtgcgttgtgcaacaccattacctctgttcctcctcctggaatggac

SEQ ID NO: 2523 - DNA, 262 bp, Glycine max
gggaagccaacttgtgtgtaatgggtgtaggaacatcttggtttaccctagaggagcaaccaatgtttgctgtgcattgtgcaacaccgttacctctgttcctcctcctggaatggacatgtcacaactttattgtggaggctgtacgacattgctaatgtacacacgtggtgctacaagtgtgagatgttcctgctgtcacactattaaccttgtaccagtactagaatctaatcaagtcattcattgtacgaactgccgg

SEQ ID NO: 2524 - DNA, 284 bp, Glycine max
gccaaatcaaaatattgaaaagccgcgaggtaggtttcgtttcgtttcgttcagttcacacattctattctctatcgattcctcttccctttttctcaatccactacaccacagttatgaggagccaacttgtgtgtaatgggtgtaggagcatcttggtttaccttagaggagcaaccaatgtttgctgtgcgttgtgcaacaccattacctctgttcctcctcctggaatggacatgtcacaactctatcgtggaggctgtacgacattgctaatgtacaca

SEQ ID NO: 2525 - DNA, 438 bp, Glycine max
acgcgtccgaaaatattgaaaagccgcgagggaggtttcgtttcgtttcgttcagttcacacattctattctctatcgattcctcttccctttttctcaatccactacaccacagttatgaggagccaacttgtgtgtaatgggtgtaggagcatcttggtttaccctagaggagcaaccaatgtttgctgtgcgttgtgcaacaccattacctctgttcctcctcctggaatggacatgtcacaactctattgtggaggctgtacgacattgctaatgtacacacgtggtgctacaagtgtgagatgttcctgctgtcacactattaaccttgtaccagaatctaatcaagtcattcattgtgcgaactgccggacaacactcatgtatccttatggagcttcctcagtcaaatgtgcaatttgttgctatattact

SEQ ID NO: 2526 - DNA, 429 bp, Glycine max
gccgcgagggaggtttcgtttcgtttcgttcagttcacacattctattctctatcgattggtcttccctttttctcaatccactacaccacagttatgaggagccaacttgtgtgtaatgggtgtaggagcatcttggtttaccctagaggagcaaccaatgtttgctgtgcgttgtgcaacaccattacctctgttcctcctcctggaatggacatgtcacaactctattgtggaggctgtacgacattgctaatgtacacacgtggtgctacaagtgtgagatgttcctgctgtcacactattaaccttgtaccagaatctaatcaagtcattcattgtgcgaactgccggacaacactcatgtatccttatggagcttcctcagtcaaatgtgcaatttgttgctatattactaatatcagtatga

SEQ ID NO: 2527 - DNA, 269 bp, Glycine max
ctcgagcgctcgagccgttggttgcccctcttgggtaaagcaatgtttgttgtgcattgtgcaacacagttacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcatgtccattgtgggaactgccggacaacactcatgtatccttatgga

SEQ ID NO: 2528 - DNA, 259 bp, Glycine max
gggagccacagctatgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcat

SEQ ID NO: 2529 - DNA, 251 bp, Glycine max
cagcagggtcgggagccacagctatgcagagccaagttgtgtgcaatggttgtaggagccttctgctttacccaagaggagcaaccaatgtctgttgtgcattgtgcaacacaattacctctgttcctccacctgggatggaaatgtctcaactttattgtggaggttgtaggacattgctaatgtacacacgtggagctacaagtgtgagatgttcctgctgtcacactgtaaaccttgttccaccagca

SEQ ID NO: 2530 - DNA, 318 bp, Glycine max
ggttgttgtattgtagtagtgtgtaaagtcttggtgatggatagacacaaatgcaagctttgttcaaggtctttcagcaatggcagagccttggtgggcacatgaaggctcaccttgcttctctccctctccctctccctccaaagcttcactcttgtttctcttcctctgactcagaacaagaacaatctttaagggagaatctaagaaaacttgaggatctggatctgaagcagagtgagcgagacagagtctaataagacccgactcgtcaagatccagcgcaactggaatctaccatgccagctcagctcggac

SEQ ID NO: 2531 - DNA, 234 bp, Glycine max
aagaagagaaggagttgaagtggttgttgtattgtagtagtgtgtaaagtcttggtgatggatagacacaaatgcaagctttgttcaaggtctttcagcaatggcagagcccttggtgggcacatgaggctcaccttgcttctctccctctccctctccctccaaagcttcactcttgtttctcttcctctgactcagaacaagaacaatctttaagggagaatcctaagaaaa

SEQ ID NO: 2532 - DNA, 427 bp, Glycine max
agtacggctgcgagaagacgacagaagggggagtgagtgagagaaagaagagaaggagttgaagtggttgttgtattgtagtagtgtgtaaagtcttggtgatggatagacacaaatgcaagctttgttcaaggtctttcagcaatggcagagcccttggtgggcacatgaaggctcaccttgcttctctccctctccctctccctccaaagcttcactcttgtttctcttcctctgactcagaacaagaacaatctttaagggagaatcctaagaaaaccttgaggattctggatcctgaagacagagagagcgagacagagtctaataagaaaccgactcgtcaacgattcaagcgcaactggaattctacatgccaaagctcagcctcggacaccccgaagccgaacctctcagctccgtctcc

SEQ ID NO: 2533 - DNA, 266 bp, Glycine max
ctccgtggaattgaaccactttttggtcaattctggcatgggagcgccttgcaggccggcgaagggagcgtggcggccgaggagagaatggaggaggtgccaaaggcgtgtgacaatgtcaatggtgtggcagaggatgagacttcacagaagaaggaggatgtagaaaagggtagtggcaatgatggggacttttttgattgtaacatctgtttggacctggctagggatcctgttgtaacttgttgtggtcattgttttgttgg

SEQ ID NO: 2534 - DNA, 285 bp, Glycine max
ccggcattttcaaataccacccgaggctcgtaatatctccgtggaattgaaccactttttggtcaattctggcaatggaagcgccttgcaggccggcgaagggagcgtggcggccgaggagagaatggaggaggtgccaaaggcgtgtgacaatgtcaatggtgtggcagaggatgagacttcacagaagaaggaggatgtagaaaagggtagtggcaatgatggggacttttttgattgtaacatctgtttggacctggctagggatcctgttgtaacttgttg

SEQ ID NO: 2535 - DNA, 174 bp, Glycine max
caatcttccgtttcataccatataatggagattggacatctaatcgttttagctttattatgtgtaactctcaagggagctgatgcgtcgcaatccgcgaaagattattggcactccgtttttccaaacactcgtctgcccaagcctctctgggatctagtgttgccttcccct

SEQ ID NO: 2536 - DNA, 238 bp, Glycine max
attgccttctacaatcttccgtttcataccatataatggagattggacatctaatcgttttagctttattatgtgtacctctcaagggagctgatgcgtcgcaatccgcgaaagattattggcactccgtttttccaaacactcgtctgcccaagcctctctgggatctagtgttgccttcccctaaaacaaatatgcctattaaagtcgaagaagagaagcagtattggactctctt

SEQ ID NO: 2537 - DNA, 303 bp, Glycine max
cacgcgtgcgcggactccggattcggctcgatgctggctgcacccggctcagtatcggacacgcctctgcaaagatggcaccagttgcaatcgaagggtgtgtttttttgctcacactgcagaggagcttcgtccgctgtatgtgtccactggatctgctgccccttcgccccgttcatctgcttcaggtcctaatgtcatggacatggctgctgccatgagcctttttccgggatcgccttcatcgggctcttccatgtcgccgtcccactttgggcagccaatgtccccatctgcaaatgg

SEQ ID NO: 2538 - DNA, 287 bp, Glycine max
  unsure (1)..(287): unsure at all n locations
ccgaaaccctaaccccctttcgacgaacgaagggcaatcagttgctcgctccttngatccattcttgaaattctcgttatcgctncttcgaactcaagctctctcgctcacgatttctgcttctgcaccaatttctgcggtttctcaagatttagaggttctaagtggttcatttctttgaagcatgccggggttaacgtgcaacgcttgcaacaccgaattcaaagatgatacagagcaaaagctccattacaaatccgagtggcatcgatacaatctcaagcgca

SEQ ID NO: 2539 - DNA, 260 bp, Glycine max
actcactcctaagaattcctcaattcttactccatcaccccaccatgtccaacaggttttgcaagttctatgcccgtggagcatgtttgaagggggatcaatgtgattttgctcatgagaaaaaggatgatatttgcagctattatcagaaaggattctgtgcatatggtagtagatgcagatataagcatgtcaaagcttcccaaccgtcatcttcagcaaatggacgccattctcctgttttggatcctgtggtgaat

SEQ ID NO: 2540 - DNA, 432 bp, Glycine max
ctagaaatgatttcccgtaatacaaatcaacaagttgcatgaccgatgaagaacaacacaaataaacaagcaaagtcaatgacgattgaaatgataatcccgagagaatggccaaaaaatttgaggagccctaacctccatgaaattcaaatgagcctcgagaaggtgcatgtagaccaaccaatcaccattcccagtagaagaaggcattggcatgacatagccagaatctccaccccaaggaaaatggtacgatgcaaacacgggctttccccacccaaaatcaacctttgactccggaaacctttgaccagaagaaaccacaaaacttggtccttcttccttgccatgcccacaataaatcctagacaaaccaggagctggtcgatgtacctcaacccaatcaacaagtcccaaaaaatgctcttctgt

SEQ ID NO: 2541 - DNA, 375 bp, Glycine max
  unsure (1)..(375): unsure at all n locations
ctagaaatgatttcccgtaatacaaatcaacaagttgcatgaccgatgaagaacaacagatataagcaagcaaagtcaatgacgattgaaatgataatcccgagagaatggccaaaaaatttgaggagccctaacctccatgaaattcaaatgagcctcgagaaggtgcatgtagaccaaccaatcaccattcccagtagaagaaggcattggcatgacatagccagaatctccaccccaaggaaaatggtacgatgcaaacacgggcttnccccacccaaaatcaacctttgactccggaaacctttgaccagaagaaaccacaaaacttggtccttcttccttgccatgcccacaataaatcctagacaaacc

SEQ ID NO: 2542 - DNA, 290 bp, Glycine max
gggagcctgatctatcctgggttcaatcccttgtcaaggaatctccgtccgagataaaagagaagttgacaggttctggccctgttgcatctgttgatggaccgagttcaaatccaaagtcaaatccgcaagttgagtctgttgatcattctgttctaggagcctggcttgagcaaatgcagctggatcagcttgtagtctaatcaaatttgacccattccatcttgtgataggtatttaatttcacaacgtattctttttgtcaatttttttgggtggagcaaggagag

SEQ ID NO: 2543 - DNA, 305 bp, Glycine max
  unsure (1)..(305): unsure at all n locations
gtgtttttnngtcctggctacatcccgcccaataccggacaaggctttgcaaggatgagacgggctgtgctaganaagtatgcttctttgctcacaancctgaaganctacgccctgtgtatgcttccactgggtcggctatgccatcaccaaaatcctattcagctagtggacttgacatgacagcgntgagtccattggctcttagttccacatctttgccgatgnccaactgtttcaacccnacccatgtctcccttggcagcagcttcatntcccaagagtggaagcatgtggcagaacaa

SEQ ID NO: 2544 - DNA, 297 bp, Glycine max
  unsure (1)..(297): unsure at all n locations
ttccgcaaagggacctgccagaagggtgattcctgcgagtatgctcatggtgtttttnagtcctggctacatcccgcccaataccggacaaggctttgcaaggatgagacgggctgtgctagaanagtatgcttctttgctcacaaacctgaagagctacgccctntgtatgcttccactgggtcggctatgccatcaccaanatcctattcagctantggattnacatganngcgatagtccntagctcttantactcattatgcggtgcnactgttacnanccgaccatnntcct

SEQ ID NO: 2545 - DNA, 280 bp, Glycine max
gttccgcaaagggacctgccagaagggtgattcctgcgagtatgctcatggtgtttttgagtcctggctacatcccgcccaataccggacaaggctttgcaaggatgagacgggctgtgctagaaaagtatgcttctttgctcacaaacctgaagagctacgccctgtgtatgcttccactgggtcggctatgccatcaccaaaatcctattcagctagtggacttgacatgacagcgatgagtccattggctcttagttccacatctttgccgatgcca

SEQ ID NO: 2546 - DNA, 125 bp, Glycine max
  unsure (1)..(125): unsure at all n locations
gtgtttttgagtcctggctacatcccgcccaataccngacaaggctttgcatcnnatnagacnggctgtgctagaaaagtatgcttctttgctcacaaacctgaagatntacgccctntgtatgc

SEQ ID NO: 2547 - DNA, 240 bp, Glycine max
  unsure (1)..(240): unsure at all n locations
gcaaagggacctgccagaagggtgattcctgcgagtatgttcatggtgtttttgagtcctggctacatcccgcccaataccggacaaggctttgcaaggatgagacgggctgtgctagaaaatatgcttctttgctcacaaacctgaagtgctacgccctgtgtatgcttccactgggtcggctaataantcaccaaaatcctattcagctagtggacttgacatgacagcgatgagtca

SEQ ID NO: 2548 - DNA, 237 bp, Glycine max
gattcctgcgagtatgctcatggtgtttttgagtcctggctacatcccgcccaataccggacaaggctttgcaaggatgagacgggctgtgctagaaaagtatgcttctttgctcacaaacctgaagaactacgccctgtgtatgcttccactgggtcggctatgccatcaccaaaatcctattcagctagtggacttgacatgacagcgatgagtccattggctcttagttccaca

SEQ ID NO: 2549 - DNA, 247 bp, Glycine max
ggctttgcaaggatgagacgggctgtgctagaaaagtatgcttctttgctcacaaacctgaagagctacgccctgtgtatgcttccactgggtcggctatgccatcaccaaaatcctattcagctagtggacttgacatgacagcgatgagtccattggctcttagttccacatctttgccgatgccaactgtttcaaccccacccatgtctcccttggcagcagcttcatctcccaagagtggaag

SEQ ID NO: 2550 - DNA, 143 bp, Glycine max
  unsure (1)..(143): unsure at all n locations
aangggaccngccagaagggtgattcctgtgagtatgctcatggtgtttttgagtcctggctgcatcctgcccaataccggacaaggctttgcaaggatgagactggctgcgctagaanagtctgcttctttgcccacaaaac

SEQ ID NO: 2551 - DNA, 382 bp, Glycine max
ccagaagggtgattcctgcgagtatgctcatggtgtttttgagtcctggctacatcccgcccaataccggacaaggctttgcaaggatgagacgggctgtgctagaaaagtatgcttctttgctcacaaacctgaagagctacgccctgtgtatgcttccactgggtcggctatgccatcaccaaaatcctattcagctagtggacttgacatgacagtgatgagtccattggctcttagttccacatctttgccgatgccaactgtttcaaccccacccatgtctcccttggcagcagcttcatctcccaagagtggaagcatgtggcagaacaaaataaaccttactccaccatcgttgcagctccctggtagccgactg

SEQ ID NO: 2552 - DNA, 270 bp, Glycine max
  unsure (1)..(270): unsure at all n locations
cacatttagaggtagaggcctttctatacggggcgagggtcctttaaggaatgtgaggagccgttctgcacttgatttggaatccaacctggctagggcccatttatcaaatactcatccacacaactcanactctngtggtctaccagttgaccattcttctagcgtggtcgatctgtcaactcaaacttctggcactttgacacgggattggagcccaatgagttcatgtcctcctcatggaagggtgtcatcatcagatgcaaatgc

SEQ ID NO: 2553 - DNA, 258 bp, Glycine max
ggcagtacaagcagatatttcaatgctgcaagtgcagctgatcgtcctacatcttcagaattgtggccagagaagcccaatatggattctctatatatgccttgggatcatgttaatatgacacccacatttagaggtagaggcctttctatacggggcgagggtcctttaaggaatgtgaggagccgttctgcacttgatttggaatccaaactggctagggcccatttatcaaatactcatccacacaactcatac

SEQ ID NO: 2554 - DNA, 264 bp, Glycine max
attctctatatatgccttgggaccatgttaatatgacacccacatttagaggtagaggcctatctataaggggtgagggtcctttaaggaatgtgaggagccgttctgcacttgatttggaatccaacctggctaggacccatttatcaaatactcatccacacaactcatactctactggtctaccaattgaccattctaacatggtcgatctttcaactcaaacttctggcactttgaccagggattggagcccaattggta

SEQ ID NO: 2555 - DNA, 411 bp, Glycine max
  unsure (1)..(411): unsure at all n locations
ggaattcctcctgtctgtgaaagaggcagtacaagcagatatttcaatgctgcaagtgcagctgagcgtcctacatcttcagaattgtggccagagaagcccaatatggattctctatatatgccttgggatcatgttaatatgacacccacatttagaggtagaggcctttctatacggggcgagggtcctttaaggaatgtgaggagccgttctgcacttgatttggaatccaacctggctagggcccatttatcaaatactcatccacacaactcatactctactggtctaccagttgaccattcttctagcgtggtcgatctgtcaactcaaacttctggcactttgacacgggattggagcccaatgagttcatgtcctnctcatggaagggtgtcatcatcagat

SEQ ID NO: 2556 - DNA, 253 bp, Glycine max
ggcaattccactgagaaaaggctcaggctatttggctttgagctaaacccttcatcaaaagagggttgtgccaaagaatctggtgaaggagatgaaagtgtgaactcctctaactcagcttcttctggaggagacaaaactgtgcaagagaaaacatcagccaatgaccctgatgagagaaaatttgagtgccaatattgttacaaggaatttgcaaactcccaagccctaggggggcaccaaaatgctcaca

SEQ ID NO: 2557 - DNA, 403 bp, Glycine max
agcccacgcgtccgctgcgagagacgacagaaggggactgcatttcccacctcaatattaatatatttctttccccacaagagagatcatggaaaaggatatcattcatctttctccaacatgggatggtgacaatggcaattccactgagaaaaggctcaggctatttggttttgagctaaacccttctaaagatggttatgccaaagaatctggtgaaggagatgaaagtgtgaactcctctaactcagtttcttctggaggagacaaaactgtgcaagagaaaccctctgccaaagactctgatgagagaaagtttgagtgccaatattgttacaaggaatttgcaaactcacaagccctaagaggccaccaaaatgctcacaagaaagagagaatgaag

SEQ ID NO: 2558 - DNA, 270 bp, Glycine max
tacggctgcgagaagacgacagaagggggaggcaaagagagagagagagaagaccaaaggagggtaaggaaaaacttcagcagaggaattccttgcagaagggtgcaactttactccctctctttctctcttgctctttcttgtcagggtttggtcatataagaagccatggccagttttggaggaaccacacaaaagtgcatggcttgtgccaaaactgtgtatcttgttgataagttaactgcagatagccgtgtctatcataaggct

SEQ ID NO: 2559 - DNA, 345 bp, Glycine max
  unsure (1)..(345): unsure at all n locations
caaagagagagagagagaagaccaaaggagggtaaggaaaaacttcagcagaggaattccttgcagaagggtgcaactttactccctctctttctctcttgctctttcttgtcanggtttggtcatataagaagccatggccagttttggaggaaccacacaaaagtgcatggcttgtgccaaaactgtgtatcttgttgataagttaactgcagatagccgtgtctatcataaggcttgcttccgatgccaccattgccgtaatacccttaagcttagcaactactgttcttttgagggggtgctctactgcagacctcactatgatcaactctacaagcgaac

SEQ ID NO: 2560 - DNA, 189 bp, Glycine max
  unsure (1)..(189): unsure at all n locations
anaaagncaagttcattatggggtttatgccacaacggaacaggtgaatgctgctggtgacttgtgtgctatatgccaggagaagatgcaggctcccatattgttgagctgtaaacacatgttctgtgaggagtgtgtatctgaatggtttganagagaacgaacttgcccattatgcagggcattggt

SEQ ID NO: 2561 - DNA, 406 bp, Glycine max
gtgcggcaagcagcaatggctttcaaatgtttgttgcttatttactacaaaaatggaagaggggataacttccgtcggcagggtcaaatgttaactctggtcgagtatactctgctgctgtatcgtgccttgttgccaacaccagtttggtaccgatttttcttgaacaaggattatggaagtctcttttcctcactgaccacaggattgtatctaactttcaagctaacatcagtagttgagaaggtccagtgcttcgtttctgccttaaaagcattatcaaaaaaggaagttcattatggggttcatgccacaacggaacaggtgaatgctgctggtgacatgtgtgctatatgccaggaaaagatgcaggcttccatattggtgagcctgtaacacatgttct

SEQ ID NO: 2562 - DNA, 379 bp, Glycine max
gccgaccgacgcgtccatacggcagcgagaagacgacagaagggcactactcaggcacctcctgccccgattaccggaaggggaactgcaagaggggcgacacgtgtcagttcgtgcacggcgtcttcgaatgctggctccacccttctcgctaccggacccagctctgcaaagacggaacaaattgccgccgcagagtgtgcttcttcgcccacaccagcgaccaactccgcgtcgtgacggactcatcgtcgtcgtcgtttgtttcctctcccacttcggtgctcattaactcttcgttctccgattcttcgccgtacagcttcgtccgcggaatagttaaactggatgaggaagggtcgtattcgggtctgacccg

SEQ ID NO: 2563 - DNA, 274 bp, Glycine max
cggctgtcacagcagtgccacctcctggcacagaaatggcccagttagtatgtggaggttgccatactttactcatgtacatccggggcgcgacaagtgtgcaatgttcatgttgtcacactgtcaatctagctttggaagcaaatcaggtggcacatgtcaactgtgggaactgcaggatgctactggcgtaccaatatggagcaagatccgtgaaatgtgcagtttgcaattttgtaacatcagttggggccacagcaagcaccactgagca

SEQ ID NO: 2564 - DNA, 238 bp, Glycine max
ctaaagagcagctgcagacaaacaagcctcttttggggttggattagctggtgagatccatggaagatataggtccgaattcatgcacaaggccagtgacagagaagaaagcaagaccccaagaacaattgaattgtccaaggtgcagttcaaccaacacaaagttctgttattacaacaactacagcctcacacagccaagatacttctgcaagacttgtagaaggtattggacaga

SEQ ID NO: 2565 - DNA, 281 bp, Glycine max
ggattagcgagtgagatcctccatggaagatatcggtccgaactcatgcacgaggcaagtggcagagaagaaagcaagacctcaagagcaattgaattgtccaaggtgcagttcaaccaacacaaagttctgttattacaacaactatagtctcacacagcccagatacatctgcaagacttgtagaaggtattggacagaaggagggtctctcagaaacgttcccgttggaggtggctctaggaagaacaagagggtcacctcatcaaaggttcctcctg

SEQ ID NO: 2566 - DNA, 442 bp, Glycine max
agcccacgcgtccgtacggctgcgagaagacgacagaaggggactaaagagcagctgcagacaaacaagctggtgagatccatggaagatataggtccgaattcatgcacaaggccagtgacagagaagaaagcaagaccccaagaacaattgaattgtccaaggtgcagttcaaccaacacaaagttctgttattacaacaactacagcctcacacagccaagatacttctgcaagacttgtagaaggtattggacagaaggagggtctctgagaaacgttcccgttggaggtggctctaggaaaaacaagagggtcacctcatcaaaggttcctgacttgaatccaccaattagcctctcatcagtctcagccatttcttcccaaaaccctaaaatgcaaggagtccaatgacttaatccggcttttcctgcagctatgg

SEQ ID NO: 2567 - DNA, 248 bp, Glycine max
ctcgagccactctactggtctaccaattgaccattctaacatggtcgatctttcaactcaaacttctggcactttgaccagggattggagcccaatgagtatatgtcctcctcatggaagggtgtcatcatcagatgcaaatgcttttaatcacgaggcaagtcatttccttattggaagcagttctagtaatgctcctgtagatgttggaggttttcataatgaatttggaactagtagaaatccta

SEQ ID NO: 2568 - DNA, 252 bp, Glycine max
caattgaccattctaacatggtcgatctttcaactcaaacttctggctctttgaccagggattggagcccaatgagtatatgtcctcctcatggaagggtgtcatcatcagatgcaaatgcttttaatcacgaggcaagtcatttccttattggaagcagttctagtaatgctcctgtagatgttggaggttttcataatgaatttggaactagtagaaatcctactgctcctcaaagttttcataataatc

SEQ ID NO: 2569 - DNA, 259 bp, Glycine max
ttcctgtattaatttttctctccctgagattaccaagctctgcaactttgcttctcaacatggagtatcgtctcctacccatttttactttactcaatcttgcactggtggcaatccatgctgctttacctcctgaagtttactggaagtcggtgcttcctactacgccaatgccaaaagccatcactgatatcctttaccccgattgggtggagagaaaagtacctcagtgaatgttggaggcaagggcgtaaacgtg

SEQ ID NO: 2570 - DNA, 258 bp, Glycine max
gttcctgtattaatttttctctccctgagattaccaagctctgcaactttgcttctcaacatggagtatcgtctcctacccatttttactttactcaatcttgcactggtggcaatccatgctgctttacctcctgaagtttactggaagtcggtgcttcctactacgccaatgccaaaagccatcactgatatcctttaccccgattgggtggaagagaaagtacctcagtgaatgttggaggcaagggcgtaaacg

SEQ ID NO: 2571 - DNA, 252 bp, Glycine max
gagaaacctgcagcaaccaaagtctcaagtatgtttggtggaactagagataaatgtgccggttgtcaaaaaacagtgtatcccactgaaaaggttactgtgaatggaactccttatcacaagagttgtttcaaatgcactcatggagggtgtgttattagtccctccaactacattgcacacgagggcaaactctactgcaagcaccaccacgtccaactgatcaaggagaagggtaatttaagccaactt

SEQ ID NO: 2572 - DNA, 261 bp, Glycine max
gccacacttcgaccaactggtcaaaagagatggtagtcttgacaaaagcttcgaagggacaccaaaaattgctaaaccagaaaaaaccggggaagagaaacctgcagcaaccaaagtctcaagtatgtttggtggaactagagataaatgtgccggttgtcaaaaaacagtgtatcccactgaaaaggttactgtgaatggaactccttatcacaagagttgtttcaaatgcactcatggagggtgtgttattagtccctc

SEQ ID NO: 2573 - DNA, 249 bp, Glycine max
gggacacctaaaattgctaaaccagaaaaaaccggggaagagaaacctgcagcaaccaaagtctcaagtatgtttggtggaactagagataaatgtgcgggttgtcagaaaacagtgtatcccactgaaaaggttaccgtgaatggaactccttatcacaagagttgtttcaaatgcactcatggagggtgtgttattagtccctccaactacattgcacacgaaggcaaactctactgcaagcaccac

SEQ ID NO: 2574 - DNA, 436 bp, Glycine max
cccacgcgtccgctcgatttccttctctataacacaacgctctcttctctggcgaccaaagtacttgttccagtgtctactctactcaaaaaggatttgggacatcatgtgcagtgattcgaaaagtaaactttcttccccaaccctcgtcgtcatggagaatagtaacattcagaagcagaatctggatggtctctacaactcggttttgcttgaattgtctgcatctgatgattatgaagctttcaaaagagaggtggaggaaaaaggcttagatgtgaacgaggcaggcttttggtacggtagaagaattgggtcaaagaagatgggatctgaaacgaggacccctctgatgattgctactttgtttggaagcgccaaggtgctcaattatattcttcttcagaaaggaggaggtgttgatgtgaacagggtc

SEQ ID NO: 2575 - DNA, 252 bp, Glycine max
caaatgcactcatggagggtgtgttattagtccctccaactacattgcacacgaaggcaaactctactgcaagcaccaccacatccaactgatcaaggagaagggcaatttaagccaacttgaaggtgaccatgagaagagtacagaggaagagaaaatcaacggtgaagtggttgcagctgagacatgaaatgaaatgaaatgcttgagttatgacaaatgaatattctcttcctcaagttccatatttct

SEQ ID NO: 2576 - DNA, 254 bp, Glycine max
acacgaaggcaaactctactgcaagcaccaccacatccaactgatcaaggagaagggcaatttaagccaacttgaaggtgaccatgagaagagtacagaggaagagaaaatcaacggtgaagtggttgcagctgagacatgaaatgaaatgaaatgcttgagttatgacaaatgaatattctcttcctcaagttccatatttctgtatcatgtgtttgtgctatatctcctgctttatcattatggagtccata

SEQ ID NO: 2577 - DNA, 286 bp, Glycine max
  unsure (1)..(286): unsure at all n locations
cagaaaacagtgtatcccactgaaaaggttaccgtgaatggaactccttatcncaagagttgtttcaaatgcactcatggagggtgtgttattagtccctccaactacattgcacacgaaggcaaactctactgcaagcaccaccacatccaactgatcaaggagacgggcatttaagccaacttgaaggtgaccatgagangagtacagaggaagagaaaatcaacggtgaagtggttgcagctgagacatgaaatgaatgaaatgcttgagtnatgacaatgaa

SEQ ID NO: 2578 - DNA, 340 bp, Glycine max
  unsure (1)..(340): unsure at all n locations
tatttctttttctcttctcactgcatcgcttcaggttcttctgaaaagatgtctcgcgtgtatgttggtaacttggattcacgagtcactgagagagatctcgaagacgaattccgcgttttcggagttattcggagtgtttgggttgcacgtagaccacctggtnatgcttttattgactttgatgaccgcagagacgcacaggatgctatccgtgaatggatggcaagaatggttggagggttgagctttctcacaactctagagtggagtngtggcgtggtggcgcctggtggtctgattgaatgttacagtgtgtgaacnngtcatttccntgatg

SEQ ID NO: 2579 - DNA, 259 bp, Glycine max
  unsure (1)..(259): unsure at all n locations
ttcttctgaaaagatgtctcncgtgtatgttngtaacntggattcacgagtcactgaganagatctcgnagacnaattccgcgttttcggagttattcggagngtntgggntncacgtagaccacctggtnatncttttattgactttnatgaccgcanagacncacangatgctatccgtgaattggatggcaagaatggttggagggtgagctttctcacaactctagaggtggaggnngtngtcntggtggtcgct

SEQ ID NO: 2580 - DNA, 246 bp, Glycine max
ctcgagccgctctcttctctctgcatcgcttcaggttcttctgaaaagatgtctcgcgtgtctgttggtaacttggattcacgagtcaccgagagagatctcgaagacgaattccgtgttttcggagttattcggagtgtttgggttgcacgtagaccacctggtgatgcttttattgactttgatgaccgcagagatgcacaggatgctatccgtggaattggatgggcagaatggtttggaggg

SEQ ID NO: 2581 - DNA, 248 bp, Glycine max
attttctttttctcttctcactgcatcgcttcaggttcttctgaaaagatgtctcgcgtgtatgttggtaacttggattcacgagtcactgagagagatctcgaagacgaattccgcgttttcggagttattcggagtgtttgggttgcacgtagaccacctggttatgcttttattgactttgatgaccgcagagacgcacaggatgctatccgtgaattggatggcaagaatggttggagggttga

SEQ ID NO: 2582 - DNA, 243 bp, Glycine max
acttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggtcatgcttttattgactttgatgatcgcagagatgcacaggatgctatccgtgaattggatggcaagaatggttggagggttga

SEQ ID NO: 2583 - DNA, 253 bp, Glycine max
tttcaggttcttctgaaaagatgtctcgcgtgtatgttggtaacttggattcacgagtcactgagagagatctcgaagacgaattccgcgttttcggagttattcggagtgtttgggttgcacgtagaccacctggttatgcttttattgactttgatgaccgcagagacgcacaggatgctatccgtgaattggatggcaagaatggttggcaggttgagctttctcacaactctagaggtggaggtggtgg

SEQ ID NO: 2584 - DNA, 251 bp, Glycine max
atttatttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggtaatgctttaattgactttgatgatcgcagagatgcacaggatgctatccgtgaattggatggcaagaatggttggagggttgagctt

SEQ ID NO: 2585 - DNA, 266 bp, Glycine max
ccttttctttttctcttctcactgcatcgcttcaggttcttctgaaaagatgtctcgcgtgtatgttggtaacttggattcacgagtcaccgagagagatctcgaagacgaattccgcgttttcggagttattcgcgtgtttgggttgcacgtagaccacctggttatgcttttattgactttgatgaccgcagagacgcacaggatgctatccgtgaattggatggcaagaatggttggagggttgagctttctcacaactctag

SEQ ID NO: 2586 - DNA, 233 bp, Glycine max
ctcttctcactgcatcgcttcaggttcttctgaaaagatgtctcgcgtgtatgttggtaacttggattcacgagtcaccgagaggatctcgaagacgaattccgcgttttcggagttattcggagtgtttgggttgcacgtagaccacctggttatgcttttattgactttgatgaccgcagagacgcacaggatgctatccgtgaattggatggcaagaatggttggagggt

SEQ ID NO: 2587 - DNA, 252 bp, Glycine max
ggtttttatttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggttatgcttttattgactttgatgaccgcagagatgcacaggatgctatccgtgaattggatggcaagaatggttggagggttgagc

SEQ ID NO: 2588 - DNA, 235 bp, Glycine max
gtttttatttctctcttctctctgcatcgcttcaggttcttctcaaaagatgtctcgcgtgtatgttggtaacttggattcacgagtcaccgagagagatctcgaagacgaattccgtgtactcggagttattcggagtgtttgggttgcacgtagaccacctggttatgcttttattgactttgatgaccgcagagatgcacaggatgctatccgtgaattggatggcaagaat

SEQ ID NO: 2589 - DNA, 262 bp, Glycine max
caggttcttctgaaaagatgtctcgcgtgtatgttggtaacttggattcacgagtcactgagagagatctcgaagacgaattccgcgttttcggagttattcggagtgtttgggttgcacgtagaccacctggttatgcttttattgactttgatgaccgcagagacgcacaggatgctatccgtgaattggatggcaagaatggttggagggttgagctttctcacaactctagaggtggaggtggtggtcgtggtggtcg

SEQ ID NO: 2590 - DNA, 250 bp, Glycine max
ctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggttatgcttttattgactttgatgaccgcagagatgcacaggatgctatccgtgaattggatggcaagaatggttggagggttgagctttctcaca

SEQ ID NO: 2591 - DNA, 273 bp, Glycine max
cctttatttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggttatgcttttattgactttgatgaccgcagagatgcacaggatgctatccgtgaattggatgggttttcctcaactagctagttaagtcttctttttggcctatggggc

SEQ ID NO: 2592 - DNA, 247 bp, Glycine max
cgtttttatttctctcttctctctgcatcgcttcaggttcttctgaaaagatgtctcgcgtgtctgttggtaacttggattcacgagtcaccgagagagatctcgaagacgaattccgtgttttcggagttattcggagtgtttgcgttgcacgtagaccacctggttatgcttttattgactttgatgaccgcagagatgcacaggatgctatccgtgaattggatggtatgtttagaagaattat

SEQ ID NO: 2593 - DNA, 255 bp, Glycine max
gggtttttctttttctcttctcactgcatcgcttcaggttcttctgaaaagatgtctcgcgtgtatgttggtaacttggattcacgagtcactgagagagatctcgaagacgaactccgcgttttcggagttattcggagtgtttgggttgcacgtagaccacctggttatgcttttattgactttgatgaccgcagagacgcacaggatgctatccgtgcaatggatggtatgttcagaagaattatgttgttg

SEQ ID NO: 2594 - DNA, 263 bp, Glycine max
  unsure (1)..(263): unsure at all n locations
gtttttatttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggtcatgcttttattgactttgatgaccgcagagatgcacaggatgctatccgtgaattggatggcaagaatggttggagggttganctttctcacaact

SEQ ID NO: 2595 - DNA, 280 bp, Glycine max
  unsure (1)..(280): unsure at all n locations
ctagggtttttctttttctcttctcactgcatcgcttcaggttcttctgaaaagatgtctcgcgtgtatgtnggtaacttggattcacgagtcaccgagagagatctcgaagacgaattccgcgttttcggagttattcggagtgtttgggttgcacgtagaccacctggtnatgncttttattgactttgatgaccgcagagacgcacaggatgctatccgtgaattggatggcaagaatggttggngggttgagctttctcacaactctagaggtgga

SEQ ID NO: 2596 - DNA, 291 bp, Glycine max
  unsure (1)..(291): unsure at all n locations
ccctttttctcttctcactgcatcgcttcaggttcttctgaaaagatgtctcgcgtgtatgttggtaacttggattcacgagtcaccgagaganatctcgaagacgaattccgcgttttcggagttattcggagtgtttgggttgcacgtagaccacctggtcatgcttttattgactttgatgaccgcagagacgcacaggatgctatccgtgaattggatggcaagaatggttggagggttgagctttctcacaactctagaggtggaggtggtggtcgtggtggtcgc

SEQ ID NO: 2597 - DNA, 254 bp, Glycine max
  unsure (1)..(254): unsure at all n locations
cgttttnctttttctcttctcactgcatcgcttcaggttcttctgaaaagatgtctcgcgtgtatgtnggtaacttggattcacgagtcaccgagaganatctcgaagacgaattccgcgttttcggagttattcngagtgtttgggttgcacgtagaccacctggtcatgcttttattgactttgatgaccgcagagacgcacaggatgctatccgtgaattggatggcaagaaggttggagggttgagcttt

SEQ ID NO: 2598 - DNA, 266 bp, Glycine max
  unsure (1)..(266): unsure at all n locations
ggtttttctttttctcttctcactgcatcgcttcaggttcttctgaaaagatgtctcgcgtgtatgttggtaacttggattcacgagtcactgagagagatctcgaagacgaattccgcgttttcggagttattcggantgtttgggttgcacgtagaccacctggtcatgcttttattgactttgatgaccgcagagacgcacaggatgctatccgtgaatggatggcaagaatggttggagggttgagctttctcacaactcta

SEQ ID NO: 2599 - DNA, 274 bp, Glycine max
ctcgagccgattcggctcgagggtttttctttttctcttctcactaccatcgcttcaggttcactctgaaaagatgtctcgcacgtatgttggtaacttggattcacgagtcactgagagagatctcgaagacgaattccgcgttttcggagttattcggagtgtttgggttgcacgtagaccacctggtcatgcttttattgactttgatgaccgcagagacgcacaggatgctatccgtgaattggatggcaagaatggttggagggttgag

SEQ ID NO: 2600 - DNA, 256 bp, Glycine max
atctagggtttttatttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggtaatgcttttattgactttgatgatcgcagagatgcacaggatgctatccgtgaattggatggcaagaatggttggagggttga

SEQ ID NO: 2601 - DNA, 273 bp, Glycine max
aggtttttctttttctcttgtcactgcatcgcttcaggttgttctgaaaagatgtctcgcgtgtatgttggtaacttggattgacgagtcactgagagagatctcgaagacgaattccgcgttttcggagttattcggagtgtttgggttgcacgtagaccacctggtaatgcttgtattgactttgatgaccgcagagacgcacaggatgctatccgtgaattggatggcaagaatggttggagggttgagctttctcacaactctagaggt

SEQ ID NO: 2602 - DNA, 179 bp, Glycine max
agtttttatttctctcttctctatgtatcgcttcaggttcttctgaaaagatgtctcgcgtgtatgttggtaacgtggattcacgagtcaccgagagagatctcgaagacgaattccgtgttttcggagttattcggagtgtttgggttgcacgtagaccacctggtaatgcttttatt

SEQ ID NO: 2603 - DNA, 138 bp, Glycine max
cttatctagttctctactcactgcatcgcttcaggttcttctgaaaagatgtctcgcgtgtatgttggtaacttggattcacgagtcaccgagagagatctcgaagacgaattccgcgttttcggagttattcggagt

SEQ ID NO: 2604 - DNA, 253 bp, Glycine max
  unsure (1)..(253): unsure at all n locations
atttttatttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggttatngttttattgactttgatgaccgcagagatgcacaggatgctatccgtgaattggatggcaagaatggttggagggttgagctt

SEQ ID NO: 2605 - DNA, 251 bp, Glycine max
gtttttctttttctcttctcactgcatcgcttcaggttcttctgaaaagatgtctcgcgtgtatgttggtaacttggattcacgagtcaccgagagagatctcgaagacgaattccgcgttttcggagttattcggagtgtttgggttgcacgtagaccacctggtcatgcttttattgactttgatgaccgcagagacgcacaggatgctatccgtgaattggatggcaagaatggttggagggttgagc

SEQ ID NO: 2606 - DNA, 173 bp, Glycine max
agggcttttcttattctcttctcactgcatcgcttcaggttcttctgaaaagatgtctcgcgtgtatgttggtaacttggattcacgagtcaccgagagagatctcgaagacgaattccgcgttttcggagttattcggagtgtttgggttgcacgtagaccacctggttatg

SEQ ID NO: 2607 - DNA, 264 bp, Glycine max
agtttttctttttctcttctcactgcatcgcttcaggttcttctgaaaagatgtctcgcgtgtatgttggtaacttggattcacgagtcaccgagagagatctcgaagacgaattccgcgttttcggagttattcggagtgtttgggttgcacgtagaccacctggtcatgcttttattgactttgatgaccgcagagacgcacaggatgctatccgtgaattggatggcaagaatggttggagggttgagctttctcacaact

SEQ ID NO: 2608 - DNA, 250 bp, Glycine max
gggtttttctttttctcttctcactgcatcgcttcaggttcttctgaaaagatgtctcgcgtgtatgttggtaacttggattcacgagtcaccgagagagatctcgaagacgaattccgcgttttcggagttattcggagtgtttgggttgcacgtagaccacctggtcatgcttttattgactttgatgaccgcagagacgcacaggatgctatccgtgaattggatggcaagaatggttggagggttg

SEQ ID NO: 2609 - DNA, 255 bp, Glycine max
gccctataaaactaaacgctccccttctcgaagaggccgctcgctctctagggtttttctttttctcttctcactgcatcgcttcaggttcttctgaaaagatgtctcgcgtgtatgtaggtaacttggattcacgagtcaccgagagagatctcgaagacgaattccgcgttttcggagttattcggagtgtttgggttgcacgtagaccacctggttatgcttttattgactttgatgaccgcagagacgcac

SEQ ID NO: 2610 - DNA, 156 bp, Glycine max
attctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacct

SEQ ID NO: 2611 - DNA, 265 bp, Glycine max
ctctttttctcttctcactgcatcgcttcaggttcttctgaaaagatgtctcgcgtgtatgttggtaacttggattcacgagtcaccgagagagatctcgaagacgaattccgcgttttcggagttattcggagtgtttgggttgcacgtagaccacctggtaatgcttttattgactttgatgaccgcagagacgcacaggatgctatccgtgaattggatggcaagaatggttggagggttgagctttctcacaactctagag

SEQ ID NO: 2612 - DNA, 271 bp, Glycine max
atctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggtaatgcttttattgactttgatgaccgcagagatgcacaggatgctatccgtgaattggatggcaagaatggttggagggttgagctttctcacaactctagaggtggaggtggtg

SEQ ID NO: 2613 - DNA, 279 bp, Glycine max
ctcgcgtgtatgttggtaacttggattcacgagtcaccgagagagatctcgaagacgaattccgtgttttcggagttattcggagtgtttgggttgcacgtagaccagctggtcatgcttttattgactttgatgaccgcagagatgcacaggatgctatccgtgaattggatggcaagaatggttggagggttgagctttctcacaactctagaggtggaggtggtggtcgtggtggtcgctctggtggttctgatttgaaatgttacgagtgtggtg

SEQ ID NO: 2614 - DNA, 261 bp, Glycine max
caattttcccatattattcacagaaaggctaaaagggccctataaaactaaacgctccccttctcgaagaggccgctcgctctctagggtttttctttttctcttctcactgcatcgcttcaggttcttctgaaaagatgtctcgcgtgtatgttggtaacttggattcacgagtcactgagagagatctcgaagacgaattccgcgttttcggagttattcggagtgtttgggttgcacgtagaccacctggttatgctt

SEQ ID NO: 2615 - DNA, 266 bp, Glycine max
atttttctcttctcactgcatcgcttcaggttcttctgaaaagatgtctcgcgtgtatgttggtaacttggattcacgagtcactgagagagatctcgaagacgaattccgcgttttcggagttattcggagtgtttgggttgcacgtagaccacctggttatgcttttattgactttgatgaccgcagagacgcacaggatgctatccgtgaattggatggcaagaatggttggagggttgagctttctcacaactctagaggtg

SEQ ID NO: 2616 - DNA, 251 bp, Glycine max
cttctctctgcgatgcttcatgttcttctgaaaagatttctcgcgtgtatgttggtaacttggattcacgagtcaccgagagagatctcgaagacgaattccgtgttttcggagttattcggagtgtttgggttgcacgtagaccacctggttatgcttttattgactttgatgatcgcagagatgcacaggatgctatccgtgaattggatggtatgtttagaagaattatgttgttggaatgtaataga

SEQ ID NO: 2617 - DNA, 278 bp, Glycine max
tgaaaagatgtctcgcgtgtatgttggtaacttggattcacgagtcaccgagagagatctcgaagacgaattccgcgttttcggagttattcggagtgtttgggttgcacgtagaccacctggttatgcttttattgactttgatgaccgcagagacgcacaggatgctatccgtgaattggatggcaagaatggttggagggttgagctttctcacaactctagaggtggaggtggtggtcgtggtggtcgctctggtggttctgatttgaaatgtt

SEQ ID NO: 2618 - DNA, 284 bp, Glycine max
acggctgcgagaagacgacagaagggggctcactctctagggtttttatttctctcttctctctgcatcgcttcaggttcttctgaaaagatgtctcgcgtgtatgttggtaacttggattcacgagtcaccgagagagatctcgaagacgaatcccgtgttttcggagtaattcggagtgtttgggttgcacgtagacaacctggtaatgctttaattgactttgatgaccgcagagatgcacaggatgctatccgtgaattggatggcaagaatggttggag

SEQ ID NO: 2619 - DNA, 259 bp, Glycine max
tttttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggttatgcttttattgactttgatgaccgcagagatgcacaggatgctatccgtgaattggatggcaagaatggttggagggttgagctttctcacaactc

SEQ ID NO: 2620 - DNA, 261 bp, Glycine max
atttttctttttctcttctcactgcatcgcttcaggttcttctgaaaagatgtctcgcgtgtatgttggtaacttggattcacgagtcactgagagagatctcgaagacgaattccgcgttttcggagttattcggagtgtttgggttgcacgtagaccacctggtaatgcttttattgactttgatgaccgcagagacgcacaggatgctatccgtgaattggatggcaagaatggttggagggttgagctttctcacaa

SEQ ID NO: 2621 - DNA, 358 bp, Glycine max
  unsure (1)..(358): unsure at all n locations
ccacgcgtccgtacggctgcgagaagacgacagaagggggagtgtttgggttgcacgtagaccacctggttatgcttttattgactttgatgaccgcagagacgcacaggatgctatccgtgaattggatggcaagaatggttggagggttgagctttctcacaactctagaggtggaggtggtggtcgtggtggtcgctctggtggttctgatttgaaatgttacgagtgtggtgaacctggtcattttgctcgtgaatgccgcatgcgtggtggttcaggaagacgccgtagccgtagtccgcccagattccgtangagcccaagttatgggcgaagtcctcgtgggcggtcccct

SEQ ID NO: 2622 - DNA, 424 bp, Glycine max
acgcccacgcgtccgtacggctgcgagaagacgacagaagggggccgctcactctctagggtttttatttctctcttctctctgcatcgcttcaggttcttctgaaaagatgtctcgcgtgtatgttggtaacttggattcacgagtcaccgagagagatctcgaagacgaattccgtgttttcggagttattcggagtgtttgggttgcacgtagaccacctggttatgcttttattgactttgatgaccgcagagatgcacaggatgctatccgtgaattggatggcaagaatggttggagggttgagctttctcacaactctagaggtggaggtggtggtcgtggtggtcgctctggtggttctgatttgaaatgttacgagtgtggtgaacctggtcattttgctcgtgaatgtcgcatg

SEQ ID NO: 2623 - DNA, 388 bp, Glycine max
  unsure (1)..(388): unsure at all n locations
cgcgtccatacggatgcgagaagacgacagaaggggggccgctcactctctagggtttttatttctctcttctctctgcatcgcttcaggttcttctgaaaagatgtctcgcgtgtatgttggtaacttggattcacgagtcaccgagagagatctcgaaggcgaattccgtgttttcggagttattcggagtgtttgggttgcacgtagacccacctggttaagcttttattgactttgatgaccgcagagatgcacaggatgctatccgtgaattggatggcaagaatggttggagggttgagctttctcacaactctagaggtggangtggtggtcgtggtggtcgctctggtggttctgatttgaaatgttacgagtgtggtga

SEQ ID NO: 2624 - DNA, 390 bp, Glycine max
cgcgtccgtacagctgcgagaagacgacagaagggggctcgctctctagggtttttctttttctcttctcactgcatcgcttcaggttcttctgaaaagatgtctcgcgtgtatgttggtaacttggattcacgagtcactgagagagatctcgaagacgaattccgcgttttcggagttattcggagtgtttgggttgcacgtagaccacctggttatgcttttattgactttgatgaccgcagagacgcacaggatgctatccgtgaattggatggcaagaatggttggagggttgaactttcccacaactctagaagtggaagttgtggtcgtggtggtcgctctggtggttctgaattgaaatgttacgaatgtggtgaacctggt

SEQ ID NO: 2625 - DNA, 416 bp, Glycine max
cccgcccgtccaaacggctgcgagaagacgacagaagggcactgagagagatctcgaagacgaattccgcgttttcggagttattcggagtgtttgggttgcacgtagaccacctggttatgcttttattgactttgatgaccgcagagacgcacaggatgatatccgtgaattggatggcaagaatggttggagggttgagctttctcacaactctagaggtggaggtggtggtcgtggtggtcgctctggtggttctgatttgaaatgttacgagtgtggtgaacctggtcattttgctcgtgaatgccgcatgcgtggtggttcaggaagacgccgtagccgtagtccgcccagattccgtaggagcccaagttatgggcgaaggggttacagtccccgtgggcggtccccta

SEQ ID NO: 2626 - DNA, 313 bp, Glycine max
tacggctgcgagaagactacagaagggcactgagagagatctcgaagacgaattccgcgtgttcggagttattcggagtgtgtgggttgcacgtagaccacctggttatgcttttattgactttgatgaccgcagagacgcacaggatgatatccgtgaattggatggcaagaatggttggagggttgagctttctcacaactctagaggtggaggtggtggtcgtggtggtcgctctggtggttctgatttgaaatgttacgagtgtggtgaacctggtcattttgctcgtgaatgcctcatgcgtggtggt

SEQ ID NO: 2627 - DNA, 437 bp, Glycine max
  unsure (1)..(437): unsure at all n locations
ccacgcgtccgagaaaaaagggccctataaaactaaacgctccccttctcgaagaggccgctcgctctctagggtttttctttttctcttctcactgcatcgcttcaggttcttctgaaaagatgtctcgcgtgtatgttggtaacttggattcacgagtcactgagagagatctcgaagacgaattccgcgttttcggagttattcggagtgtttgggttgcacgtagaccacctggttatgcttttattgactttgatgaccgcagagacgcacaggatgctatccgtgaattggatggcaagaatggttggagggttgagctttctcacaactctagaggtggaggtggtggtcgtggtggtcgctctggtggttctgatttgaaatgttacgagtgtggtgaanctggtcattttgcccgtgaatgccccatg

SEQ ID NO: 2628 - DNA, 404 bp, Glycine max
tgtggctcgctctctagggtttttctttttctcttggcactgcatcgcttcaggttcttctgaaaagatgtctcgcgtgtatgttggtaacttggattcacgagtcactgacagagatctcgaagacgaattccgcgttttcggagttattcggagtgtttgggttgcacgtagaccacctggttatgcttttattgactttgatgaccgcagagacgcacaggatgctatccgtgaattggatggcacgaatggttggagggttgagctttctcacaactctagaggtggacgtggtggtcgtggtggtcgctctggtggttctgatttgaaatgttacgagtgtggtgaacctggtcattttgctcgtgaatgccgcatgcgtggtggttcaggaagacgcc

SEQ ID NO: 2629 - DNA, 279 bp, Glycine max
gccctagccaacgacagcgtttctgcttccaccgtcggcggcggaaggatgcacgagtgttccatctgtcacaagagtttccctaccggtcaggccctgggtggccacaagcgctgccactacgacggcgggaacaaccacagtaacagcaacgccaacggaaacaacagcagcggcgccactacctccgacggcggcgctgcctcctcctcccacacgctccgtgggtttgacctgaaccttccggcgccgctgacggagttctggtcgccgatgggg

SEQ ID NO: 2630 - DNA, 260 bp, Glycine max
aaccccaccgcctccgtctctgccctagccaactccagcgtttctgcttccaccgtcggcggcggaaggatgcacgagtgttccatctgtcacaagagtttccctaccggtcaggccctgggtggccacaagcgctgccactacgacggcgggaacaaccacagtaacagcaacgccaacggaaacaacagcagcggcgccactacctccgacggcggcgctgcctcctcctcccacacgctccgtgggtttgacctgaa

SEQ ID NO: 2631 - DNA, 254 bp, Glycine max
  unsure (1)..(254): unsure at all n locations
gagagantaggaaaaaggganatatggcatttgcaggaacaactcagaagtgcatggcttgtgacaaaacagtttatcnggttgataagttgacagcagataaccgngtgtaccataaggcttgcttcagatgccaccactggcaaaggaacactcaagcttagcaactataactcttttgagggggttctttactgcaggccacacttcgaccnaactggtcaaaagnactgggagtcttgacaaaagcttcc

SEQ ID NO: 2632 - DNA, 270 bp, Glycine max
ctcgagccgcagaacatagcttgtgttggtgaggtgagaagataaagaaagaatggcatttgcaggaacaacacagaagtgtatggcctgtgacaaaaccgttaatctggttgataagttgaccgcggataaccgagttttccacaaagcttgcttcagatgccatcactgcaaaggaaccctcaagctgagcaactacaactcttttaagggagttctttatcgtaagccacactttgaccaactgttcaaaggaccagggagcttgac

SEQ ID NO: 2633 - DNA, 383 bp, Glycine max
cctctgtctcctcctcaatcttcattgtgctgggctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgaattttccacaaagcttgcttcagatgccatcactgcaaaggaaccctcaagctgagcaactacaactcttttgagggagttctttattgtaagccacactttgaccaactgttcaaaagaacagggagccttgacaaaagctttgaaggaacaccaaaaattgccaagccagagaaaaatttggaaga

SEQ ID NO: 2634 - DNA, 253 bp, Glycine max
  unsure (1)..(253): unsure at all n locations
gtgaagaagagaggttgatcctgaagaggattnggttgacggtgctgcaaagtccttgactgatttgaatgtgaatgagcatggtgaaaatgttgatatggaggaagatgatgattttgaggagttagacccctcttgttgcntatgtgtgatcaagagcacaaaacaatagaagactgcatggttcacatgncacaagcatcatggattcttcattccagatgttgagtatttgaaggatccaaaaggcctc

SEQ ID NO: 2635 - DNA, 248 bp, Glycine max
tgaagaagagaggttgatcctgaagaggatttggttgacggtgctgcaaagtccttgactgatttgaatgtgaatgagcatggtgaaaatgttgatatggaggaagatgatgattttgaggagttagacccctcttgttgctttatgtgtgatcaagagcacaaaacaatagaagactgcatggttcacatgcacaagcatcatggattcttcatccagatgttgagtatttgaaggatccaaaaggc

SEQ ID NO: 2636 - DNA, 253 bp, Glycine max
  unsure (1)..(253): unsure at all n locations
gtgaagaagagaggttgatcctgaagaggatttggttgacggtgctgcaaagtccttgactgatttgaatgtgaatgagcatggtgaaaatgttganatggaggaagatgatgattttgaggagttagacccctcttgttgctttatgtgtgatcaagagcacaaaacaatagaagactgcatggttcacatgcnnaagcatcatggattcttcattccagatgttgagtatttgaaggatccaaaaggcctc

SEQ ID NO: 2637 - DNA, 249 bp, Glycine max
ttcacaatcccaacacccattttggagaatcagaatctaactagccaatagccatgaagagacagagagagaacgaagtaacaacgttggaaaactgggacatgcaaatttgttcaacttcaatcacacccgacacaagtgtttccagttccaccatatctccggaagatgtatttgagtgcaaaacgtgcaaccgcaagttcaactcttttcaagcgctgggtggccatagggcttgtcacaacaaga

SEQ ID NO: 2638 - DNA, 250 bp, Glycine max
ggaatgtccagtttgtaagggagaggtgacacttaaaagtgttaccccaatatatggccgtgcgaacaatgtccgtggtcctgaggaggattctgcacttaagatccctcccaggccccaagcgaagagagttgagagtctgagacaaaccattcagagaaatgcatttgcactccctgtggaagagatgattcggcgtcttggaagcagaattgagcttacacgcgatttggttcagccacctgaaccg

SEQ ID NO: 2639 - DNA, 245 bp, Glycine max
ggaatgtccagtttgtaagcgagaggtgacacttaaaagtgttaccccaatatatggccgtgcgaacaatgtccgtggagctgaggaggattctgcacttaagatccctcccaggccccaagcgaagagagttgagagtctgagacaaaccattcagagaaatgcatttgcactccctgtggaagagatgattcggcgtcttggaagcagaattgagcttacacgcgatttggttcagccacctg

SEQ ID NO: 2640 - DNA, 353 bp, Glycine max
gacccacgcatccagtttgtaagggagaggtgacacttaaaagtgttaccccaatatatggccgtgcgaacaatgtccgtggtcctgaggaggattctgcacttaagatccctcccaggccccaagcgaagagagttgagagtctgagacaaaccattcagagaaatgcatttgcactccctgtggaagagatgattcggcgtcttggaagcagaattgagcttacacgcgatttggttcagccacctgaaccggatgctgcccgtgaaacagctgagagaaccacttccttgctaaggttcttgactgcgccagggatacgtgcagagcatcagaatccagtgggcaccccc

SEQ ID NO: 2641 - DNA, 230 bp, Glycine max
  unsure (1)..(230): unsure at all n locations
gtattttgatccaccggatagtagttggggagcatgtttcaattgtggtgangatggtcatgctgctgtgaactgttcagcagcgaangttcagnnaccatgctatgtttgtggtggtttgggacacaatgcaagacaatgcactaaggcgcaagattgctttatctgcaagaaaggtggtcaccgtgctaaagactgtctggagaagcacacaagtagatcaaaaagtg

SEQ ID NO: 2642 - DNA, 283 bp, Glycine max
  unsure (1)..(283): unsure at all n locations
attaaccacaagcataagcacaagcacaagcacaagcacttctctaattccctttcacactctattacagatttcacaagtgcttacacttcaaatggctttggaagctcttcaatcacccaccancanccactccatcgtttagtccctttganganaccagtctcagttacttagagacaccgtggacgaaaggaangcgttctaagcgtanccggcacggagcaacaactgcaacacccttcatgcaccgaggaagagtacctcgctctttgtctcatca

SEQ ID NO: 2643 - DNA, 288 bp, Glycine max
  unsure (1)..(288): unsure at all n locations
taagcacaagcacaagcacaagcacttctctaattccctttcacactctattacagatttcacaagtgcttacacttcaaatggctttggaagctcttcaatcacccaccananccactccatcgtttagtccctttgaagaaaccagtctcagttacttagagacaccgtggacgaaaggaaagcgttctaagcgtancgccacggagcaacaactgcaacacccttccatgcaccgaggaagagtacctcgctctttgtctcatcatgctcgntcgcggcggcgcg

SEQ ID NO: 2644 - DNA, 284 bp, Glycine max
gagcaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtaccgcacggagcaacaactgcaacacccttcatgcaccgaggaagagtacctcgctcttgtcatcagctgtcgcggcg

SEQ ID NO: 2645 - DNA, 262 bp, Glycine max
gtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgctgcggcgccggcagtgtctccaccgccaaacccgctgtctccgacaacaattctgcgccgctatccgccgccaaactgagctacaaatgttcggtttgcaacaagcttctcta

SEQ ID NO: 2646 - DNA, 277 bp, Glycine max
gttcaccagaagcaaccacaacaagcacttctcttatttcctatcacaccctattacagattcacaagcgcagacacttcaaatgggtctggaagctcttcaatcacccagaactgccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgct

SEQ ID NO: 2647 - DNA, 265 bp, Glycine max
  unsure (1)..(265): unsure at all n locations
gattcacaagcgcagacacttcaaatggctctggaagctcttcaatcacccagaactgccactccatcgtttagtccctttgaagaaaccaacctcagttacttggagacaccgtggaccaaaggaaagcgttctaagcgtanccggcatggagcagcaactgcaacactcttcatgcaccgaggaagagtacctcgctctctgtctcatcatgctcgctcacggcggcgcggcggtgtccccgccgccaagcctgctgtctccg

SEQ ID NO: 2648 - DNA, 271 bp, Glycine max
ccaaactcaagttcaccaaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagcgcatggagcagcaactgcaacactcttcatgcaccgaggaagagtacctcgctctctgt

SEQ ID NO: 2649 - DNA, 286 bp, Glycine max
aagcacttctcttatttcctatcacaccctattacagattcacaagcgcagacacttcaaatggctctggaagctcttcaatcacccagaagtgccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgctcacggcggcgccagcggtgtccccgccgcca

SEQ ID NO: 2650 - DNA, 232 bp, Glycine max
gcagacacttcaaatggctctggaagctcttcaatcacccagaactgccactccatcgtttagtccctttgaagaaaccaacctcagttacttggagacaccgtggaccaaaggaaagcgttctaagcgtaccgcatggagcagcaactgcaacactcttcatgcaccgaggaagagtacctcgctctctgtctcatcatgctcgctcacggcggcgccggcggtgtccccg

SEQ ID NO: 2651 - DNA, 273 bp, Glycine max
ccaaactcaagttcaccaaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagcgcatggagcagcaactgcaacactcttcatgcaccgaggaagagtacctcgctctctgtct

SEQ ID NO: 2652 - DNA, 293 bp, Glycine max
ccaaaagcaaccacaacaagcacttctcttatttcctatcacaccctattacagattcacaagcgcagacacttcaaatggctctggaagctcttcaatcacccagaagggccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgctcacggcggcgccggcggtgtc

SEQ ID NO: 2653 - DNA, 260 bp, Glycine max
caacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgctc

SEQ ID NO: 2654 - DNA, 271 bp, Glycine max
caaaagcaaccacaacaagcacttctcttatttcctatcacaccctattacagattcacaagcgcagacacttcaaatggctctggaagctcttcaatcacccagaacagccactccatcgtttagtccctttgaagaaaccaacctcagttacttggagacaccgtggaccaaaggaaagcgttctaagcgtagcgcatggagcagcaactgcaacactcttcatgcaccgaggaagagtacctcgctctctgtctcatcatgctcgctc

SEQ ID NO: 2655 - DNA, 196 bp, Glycine max
ccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttac

SEQ ID NO: 2656 - DNA, 258 bp, Glycine max
caaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagcgcatggagcagcaactgcaacactcttcatgcaccgaggaagagtacctcgctctctgtctc

SEQ ID NO: 2657 - DNA, 263 bp, Glycine max
atcaagttcaccaaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagcgcatggagcagcaactgcaacactcatcatgcaccgaggaagagtacctcgctctc

SEQ ID NO: 2658 - DNA, 283 bp, Glycine max
cacaagcacaagcacttctctaattccctttcacactctattacagatttcacaagtgcttacacttcaaatggctttagaagctcttcaatcacccaccacatccactccatcgtttagtccctttgaagaaaccagtctcagttacttagagacaccgtggacgaaaggaaagcgttctaagcgtagcgcacggagcaacaactgcaacacccttcatgcaccgaggaagagtacctcgctctttgtctcatcatgctcgctcgcggcggcgccggcagtg

SEQ ID NO: 2659 - DNA, 345 bp, Glycine max
ataagcacaagcacaagcacaagcacttctctaattcccttgcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaccaactgcaacacctttaatgcaccgaggaagagcacctctctctgtgtcaataacgctctctcgggggggcccccactgtgtctacagcgacaaacgctgtgtctgagaacacatttgtgcccctatatgcc

SEQ ID NO: 2660 - DNA, 429 bp, Glycine max
gacccacgcgtcagacggctgcgagaagacgacagaaggggactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatg

SEQ ID NO: 2661 - DNA, 429 bp, Glycine max
tacggctgcgagaagacgacagaaggggactcaaaattaaccacaagcataagcacaagcacaagcacaagcacttctctaattccctttcacactctattacagacttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaagcccgctgtctccgaaaacaattctgcgccgctatccgccgccaaactgagctacaaatgttcggtttgcaac

SEQ ID NO: 2662 - DNA, 342 bp, Glycine max
  unsure (1)..(342): unsure at all n locations
aaaaaaaaatgtagaggaacctggaaacttccacgaggttttnggtgaaaaccaaatttggggctttgcatcgcaagatttaccctttccaatcaaaattcttctgccttcccctaccaattctttctctcaaccgatttatctgagtgaggggtttggccaatgacgagtggttttggtgaatcaacgagagcgtctgcaccgagcccatcatgctcggggaacagttcaaacgatgcnggtgattttgaatgcaacatatgcttcgatttggcgcaagaccctgtgatcacactctgtggtcacctnttctgttggccatgcctttataggtggctccac

SEQ ID NO: 2663 - DNA, 252 bp, Glycine max
attctttctctcaaccgatttatctgagtgaggggtttggccaatgacgagtggttttggtgaatccaacgagagcgtctgcaccgagcccatcatgctcggggaacagttcaaacgatgccggtgattttgaatgcaacatatgcttcgatttggcgcaagaccctgtgatcacactctgtggtcacctattctgttggccatgcctttataggtggctccaccatcactcccattctcaggaatgccctg

SEQ ID NO: 2664 - DNA, 426 bp, Glycine max
caaaatactactagtaccttaataaacaaataaataaataaggtgagagaaaaaaaaaaatgtagaggaacctggaaacttccacgaggttttcggtgaaaaccaaatttggggctttgcatcgcaagatttaccctttccaatcaaaattcttctgccttcccctaccaattctttctctcaaccgatttatctgagtgaggggtttggccaatgacgagtggttttggtgaatcaacgagagcgtctgcaccgagcccatcatgctcggggaacagttcaaacgatgccggtgaatttgaatgcaacatatgcttcgatttggcgcaagaccctgtgatcacactctgtggtcacctattctgttggccatgcctttataggtggctccaccatcactcccattctcaagaatgccctgtttgc

SEQ ID NO: 2665 - DNA, 250 bp, Glycine max
gagggaaagatgcagatattcgtgaaaaccctaaccgggaagaccatcacccttgaggtggagtcaagcgacaccattgacaatgtcaaagccaagattcaggacaaagaagggattcctccggatcagcagaggttgatcttcgccggtaaacagctggaagatggccgtaccctcgctgattataacatccaaaaagagtcaacattgcatcttgttttaaggcttcgtggtggtattattgagccat

SEQ ID NO: 2666 - DNA, 245 bp, Glycine max
gggaaggaaagatgcagatattcgtgaaaaccctaaccgggaagacaatcacccttgaggtggagtcaagcgacaccattgacaatgtcaaagccaagattcaggacaaagaagggattcctccggatcagcagaggttgatcttcgcggggaaacagctggaggatggccgtaccctcgccgattacaacatccaaaaagagtcaacattgcatcttgttttgaggcttcgtggtggtattatt

SEQ ID NO: 2667 - DNA, 262 bp, Glycine max
aaacacactgctgaaaaccctagctataaatttctacacccaccgacggcagaaaccctagtagtagttttgaaagggaaggaaagatgcagatattcgtgaaaaccctaaccgggaagacaatcacccttgaggtggagtcaagcgacaccattgacaatgtcaaagccaagattcaggacaaagaagggattcctccggatcagcagaggttgatcttcgccgggaaacagctggaggatggccgtaccctcgccgatta

SEQ ID NO: 2668 - DNA, 257 bp, Glycine max
gggaaggaaagatgcagatattcgtgaaaaccctaaccgggaagacaatcacccttgaggtggagtcaagcgacaccattgacaatgtcaaagccaagattcaggacaaagaagggattcctccggatcagcagaggttgatcttcgccgggaaacagctggaggatggccgtaccctcgccgattacaacatccaaaaagagtcaacattgcatcttgttttgaggcttcgtggtggtattattgagccatctttg

SEQ ID NO: 2669 - DNA, 242 bp, Glycine max
  unsure (1)..(242): unsure at all n locations
taacccggtaactaaacacactgctgaaaaccctagctataaatttctacacccaccgacggcagaaaccctagtagtagttttgaaagggaaggnaagatgcagatattcgtgaaanccctaaccgggaagacaatcacccttgaggtggagtcaagcgacaccattgacaatgtcaaagccaagattcaggacaaagaagggattcctccggatcagcagangttgatcttcgccgggaa

SEQ ID NO: 2670 - DNA, 266 bp, Glycine max
gtgaaaaccctaaccgggaagacaatcacccttgaggtggagtcaagcgacaccattgacaatgtcaaagccaagattcaggacaaagaagggattcctccggatcagcagaggttgatcttcgccgggaaacagctggaggatggccgtaccctcgccgattacaacatccaaaaagagtcaacattgcatcttgttttgaggcttcgtggtggtattattgagccatctttgatggcactggcgaggaaatataaccaggataa

SEQ ID NO: 2671 - DNA, 251 bp, Glycine max
  unsure (1)..(251): unsure at all n locations
aaaccctaaccgggaagaccatcacccttgaggtggagtcaagcgacaccattgacaatgtcaaagccaagattcaggacaaagaagggattcctccggatcagcagaggttgatcttcgccggtaaacagctggaagatggccgtaccctcgctgattataacatccanaaagagtcaacattgcatcttgtttaaaggcttcgtggtggtattattgagccatctttgatggcactggcgaggaattat

SEQ ID NO: 2672 - DNA, 255 bp, Glycine max
ggaaagatgcagatattcgtgaaaaccctaaccgggaatacaatcacccttgaggtggagtcaagcgacaccattgacaatgtcaaagccaagattcaggacaaagaagggattcctccggatcagcagaggttgatcttcgccgggaaacagctggaggatggccgtaccctcgccgattacaacatccaaaaagagtcaacattgcatcttgttttgaggcttcgtggtggtattattgagccatctttgatg

SEQ ID NO: 2673 - DNA, 279 bp, Glycine max
  unsure (1)..(279): unsure at all n locations
atttttcatacaacacattctttctagacacgcaacacctagaagatttccttnttctttttggtgctaaaccgttgggatatagcaacaacatgttaggaatgaagagacatagagataatgaagggtcagagagcttagatttggcaaaatgtcttgtgctgttctcttgtccaatagaaagcaacaaggcacaacagaaaggttttggggctgtggaatttagtgcaagacgtgcagccgcaagttctcttcttttcaagcactgggagggcacag

SEQ ID NO: 2674 - DNA, 265 bp, Glycine max
ttctcgagccgattcggctcgagctaaaccgttgggatatagcaaactcatgttaggaatgacagagacatagagataatgactggtcagagagcttagatttggcaaaatgtcttgtgctgttctcttgtccaatagaaagcaacaaggcacaacagaaaggttttggggctgtggaatttgagtgcaagacgtgcagccgcaagttctcttcttttcaagcactgggagggcacagggcaagccacaagaggcagaagctaga

SEQ ID NO: 2675 - DNA, 298 bp, Glycine max
  unsure (1)..(298): unsure at all n locations
caccgctttctttctctctcgcnctctctctgcgttgttggagaacattcagaaaaaaaaaggagagtgagccgaaaaaaacaattcagaaaatggagaacaacgcattcagagatcgaatcttggaggacaatgaacacgaagaaatccctgattcctttgtttgctgcgtttgtctggatctattatacaagcccattgtgctatcttgtggtcacatatgctgtttctggtgtgtctataattcaatgaattgtctgcgggagtctcaatgtccagtatgtaggaatcaatatta

SEQ ID NO: 2676 - DNA, 268 bp, Glycine max
ctcgagccgtcagattggagttcccctaccgggaaactggattggggtgtaaacggagactagctgaacaagctgaggaaatctacttcctttggattcagaaacagtggggtaactgcatcccccatagcacagctgaattttggtgctgagccggatgtctcatgggttcattcattggttaaagatgttccctccgagaggtctgagatatttggtgctgagaagcaacaatatgatctcagtaaagagatgcttccaccatgga

SEQ ID NO: 2677 - DNA, 255 bp, Glycine max
ctaccctttcagattggagttcccctaccgggaaactggattggggtgtaaacggagacaagctgaacaagctgaggaaatctacttcctttggattcagaaacagtggggtaactgcatcccccatagcacagcctgaatttggtgctgagccggatgtctcatgggttcattcattggttaaagatgttccctccgagaggtctgagatatttggtgctgagaagcaacaatatgatctcagtaaagagatgc

SEQ ID NO: 2678 - DNA, 259 bp, Glycine max
gtcaacaaacagtgaaagaagaagatgatgaaggtccacctccgggatggcaacctctccccgctcagccaccgccaccgccacgtccatccggttggctcaaatggtttgcggttcttgtcgtcgcctgctttcatatccacgaggtgccaaacatgtcaaatgttcatgctgtcagactgtcaacattgtattagaagctgatcaggttgggcaagttaagtgtggcagttgtgcggtattgctgatgtacccatat

SEQ ID NO: 2679 - DNA, 279 bp, Glycine max
cgaagatgcaaagtcaacaaacagtgaaagaagaagatgatgaaggtccacctccgggatggcaatctctccccggttaaccaacggcaacggcaagttcaatccggttgggctcaaatggtttgcggttcttgtcgtcgcctgctttcatatccacgaggtgccaaacatgtcaaatgttcatgctgtcagactgtcaacattgtattagaagctgatcaggttgggcaagttaggtgtggcagttgtgcggtattgctgatgtacccatatggtgct

SEQ ID NO: 2680 - DNA, 262 bp, Glycine max
ctgatccagcagcgggttccgtgttttcccctacgcacaaatcagctgttctcaatcagtttcaacagctccaaagtatgttatcacctataaatactaacttgctatctcctaagaatgttgagcatcctcttttacaggcttcctttggtgtatctccttcgggtaggatgtcaccaagaagtgttgaaccaatctctccaatgagctctcgcatatcggcatttgctcagcgcgaaaaacagcagcagcagcagcagca

SEQ ID NO: 2681 - DNA, 248 bp, Glycine max
gctcttttctgctgagatttctttgtctccccggtattctgatccagcagccggttctgtgttttcccctactcacaaatcagctgttctcaatcagtttcaacagctccaaagtatgttatcacctataaatactaatttgctgtctcctaagaatgttgagcatcctctttttcaggcttcttttggtgtctctccttctggaaggatgtcaccaagaagtgttgaaccaatctctccaatgagtg

SEQ ID NO: 2682 - DNA, 262 bp, Glycine max
gtgctcgtgacattccaccagaagacttgaacatgatgtctgatcttgatggccagcagcagcaccatctgaatgacttgagctgttacatacagcctcgccccggtgccagttctgtgagtagatctggtcggtccaagaccctaactccatcaaatctggaagagctcttttctgctgagatttctttgtctccccggtattctgatccagcagccggttctgtgttttcccctactcacaaatcagctgttctcaatca

SEQ ID NO: 2683 - DNA, 255 bp, Glycine max
gtcttcccttagtgcccgcgacatgccaccagacgacttgaacatgatgtctgatcttgatggccagcagcagcatcctttgaatgacttgagctgttacttacagccgcggcctggtgctggttctgtgagtagatctggtcggtccaagatcctaactccatcaaatcttgaagatctcttttctgctgagatttcttcatctccccggtattctgatccagcagcgggttccgtgttttcccctacgcacaa

SEQ ID NO: 2684 - DNA, 273 bp, Glycine max
ctttctgctgagatttctttgtctccccggtattctgatccagcagccggttctgtgttttcccctactcacaaatcagctgttctcaatcagtttcaacagctccaaagtatgttatcacctataaatactaatttgctgtctcctaagaatgttgagcatcctctttttcaggcttcctttggtgtctctccttctggaaggatgtcaccaagaagtgttgaaccaatctctccaatgagtgctcgtttatctggcattgctcagcgagag

SEQ ID NO: 2685 - DNA, 384 bp, Glycine max
gccagcagcagcaccatctgaatgacttgagctgttacatacagcctcgccccggtgccagttctgtgagtagatctggtcggtccaagaccctaactccatcaaatctggaagagctcttttctgctgagatttctttgtctccccggtattctgatccagcagccggttctgtgttttcccctactcacaaatcagctgttctcaatcagtttcaacagctccaaagtatgttatcacctataaatactaatttgctgtctcctaagaatgttgagcatcctctttttcaggcttcatttggtgtctctccttctggaaggatgtcaccaagaagtgttgaaccaatctctccaatgagtgctcgtttatctgcatttgctc

SEQ ID NO: 2686 - DNA, 282 bp, Glycine max
  unsure (1)..(282): unsure at all n locations
gcaacccaccaccatcttggggggatgtcttccccttccaaccctttcctgcagggtgtcctctaccctttcaggttggagttcccctaccgggaaactggattggggcgtaaatggagatgagctgaacaagctgaggaaatctgcttcctttggtttcagaaacagtggggtaactgnnnnnnnnnnnnnnnnccccatagcacagccagaatttggcaccgagcaggatgtctcgtgggttcattcattggttaaagatgttccctccgagaggtctga

SEQ ID NO: 2687 - DNA, 280 bp, Glycine max
  unsure (1)..(280): unsure at all n locations
ctttgaacatgaaccccaacgatgggcaacaactctcccagtcccaagcccttggagatggtcaacccggttcctccgtttctttctaagaccttcgacctcgtcgacgccccgactctcgacncgatcatctcgtggaactccacggcctcagcttcgtcgtgtgggaccctctcgagttcgcgagaattgtccttcctcgacatttcaagcacaacaacttttccagttcgttcgcnaactcaatattatgtgagtatcatttcaatcaaagaaataa

SEQ ID NO: 2688 - DNA, 272 bp, Glycine max
cgagaggagcattgcagaggtggggaacctggaatggaatctctgatccattttgtgtgttgaatttgattttgtattgttatagattacagatttggtgggcaatggatagggacaacaaatctcctccaccttcttctctttatgtgaaatcatcatcttcatccttcagccacgacgacataagcgccatgccggagaatccacccaagaacagaggccacagacgcgcccattccgagattataaccctaccggacgacctatccttc

SEQ ID NO: 2689 - DNA, 279 bp, Glycine max
  unsure (1)..(279): unsure at all n locations
ttactgactctctttgtcaccgggtttgtgagatgtcggatgcacnggcgagtccgagtccacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagctttcattaccagcgaggcgagtgagaangccagaaggag

SEQ ID NO: 2690 - DNA, 283 bp, Glycine max
tcggcttccggcgagaggttggtgtcggcggcgagggacggcgatttggttgaggcgaagatgcttctggaatgcaacccttgtcttgcaaagtactcaactttcgggggtctcaattcccctcttcattttgcagcttccaagggccataacgagattgtggcattgttgcttgaaaatggagctgatgtgaattcgagaaattattgtgggcagaccgctttgatgcaagcttgtagatatggacatgggaagttgtacagacccttctgctcttcaaatg

SEQ ID NO: 2691 - DNA, 284 bp, Glycine max
  unsure (1)..(284): unsure at all n locations
gctcatcctaagaaacgtgcggngcgtcgaatttttaaggagacaaggcatcccgtgtacanangagtgcggcgnaggnacaacaacaagtgggnctgcgaggttcgtgtncncaacgncaantccacgangatttggctcgnaacgtatccaacgcctnanatggccgnacgnncgcacgacgtcnccgcgctctcncttcgaggtaagtcggcgtgtctcaanttcgncgactcagctngcggttgcccttgccggcgtcgaccaatgcgaaggagattcgg

SEQ ID NO: 2692 - DNA, 309 bp, Glycine max
  unsure (1)..(309): unsure at all n locations
gaaaaatagaanttnttcaaagangggtgtcattggacccaactttgaaatcccagnttaaggnntggcntgtnanggacacngtcttctccntctcttgatgnccggtcaactgcatcacaggttattgcnaaagttgctggcattgagttgcctcataaacagtggcctganttgataggatccctcttgtctaatgctcatcagcttcctgcccctacaagacaggcaacacttgagacccttggttacatctgtgaagaagtntcccctgatgtagtagaccaggatcatgtaaataagatacnc

SEQ ID NO: 2693 - DNA, 276 bp, Glycine max
  unsure (1)..(276): unsure at all n locations
gcgctgctcatcttctccagcaccggaaanctctacgagctctgcaacggtgacagtttggccgaggtcgtgcagcaatattgggatcatttaggagcgagcggtactgacacaaagtcgcaggaactatgctttgaaattgcaganatctggtctggttcagcgttttctcaaatgatcaaaaggcacttcggtgtttctgaacttgagcatctgagtgtgtctgaccttatggaactagagaaactgactcatgctgctctttcgcgaatcaga

SEQ ID NO: 2694 - DNA, 277 bp, Glycine max
  unsure (1)..(277): unsure at all n locations
gggaaaagntgcagantccgctggattaactatttgaggcctgatatcaagagagggaatttcacaattgaagaagaagaaactatcattaagctgcatgagatgttggggaacaggtggtcagcaattgcagccaaattgccagaagaactgacaatgacncanaaaatgtttggcacaccaatttgaagaagaggctgctgaaatcagaccagtccaagccaagttccaaaagagccataagccaaatattaaacgttctgattccantccagca

SEQ ID NO: 2695 - DNA, 157 bp, Glycine max
  unsure (1)..(157): unsure at all n locations
gcagcaacaccanaaacnacnaaggcaatatgggcanggctccttgctgcgacaaagcaaacgtgcagaaaggtccatggtccancaagaagaagtgctaagctcnaatcctacatagnaaagcatggcncnggtggtaactggantgnttgcctca

SEQ ID NO: 2696 - DNA, 332 bp, Glycine max
  unsure (1)..(332): unsure at all n locations
caaacattaagtactgttccttaacaaaaaanaaaancagaatggctgagctacctagctcagaagcatcgtcatcatcngcttccagtcggaagcactcgtnttnggaggcccatttacccgccccggntcagaaaaggcccaagcaggcccgagatagcagcagcaagcaccccgtntacagaggggtccgaatgcgggcctggggaaagtgggtatccgaaatacgcgagcccagaaagaagaaccggatctggctcggaactttgccacccgagatggccgcantgcgacgacgtggcggcgtcgccatcaaggnantcgcctttcaa

SEQ ID NO: 2697 - DNA, 185 bp, Glycine max
gaatttcatggacatggtggcttccatgcccgccatgaagctcgataagctctatgaaaacggattcatctgtgaagctattctcaggtctcttctgcctcttgcgaagaaatacgtcatacagatgctgcatattgatgtgtcagtggcagctaaattgttggaggaatgggtgcttccgggtg

SEQ ID NO: 2698 - DNA, 279 bp, Glycine max
aaaaataacaaaaaacgaaaaaaaatccatcgattccctgcacttccatgtcttctttgtctacgcatcacacctatagccgaaagcaaaaatctctcggcctcctgtgcaccaattttttgagtttgtacaacaaggaaggtgtgcgattaatcggtttggatgatgcagcttcacgattaggagtagaaagacgaaggatctacgacatcgttaacattttagagagtgtggggtgctagctagaaaagctaagaatcaatgtacctggaagggttt

SEQ ID NO: 2699 - DNA, 313 bp, Glycine max
  unsure (1)..(313): unsure at all n locations
ccctctgtctctaccctgcggctagggttttgtctttcactcactctctttctttctccgttcttcctttttctctcatttcccttctctttcgatctgaataataatcaaccatggaaagacgtggttatggtggacctcgtgggccctaccnnnnnnnnnnnnnnnnnnnnnnnnnnnnnggaggttttaccaacggtgaagttggtgaagaaggacgcccaagaagagcatttgaacaccacagtgggactggacgaggaaatgaattcaaacgggatggctctggacgtgggaactggggtacacagaa

SEQ ID NO: 2700 - DNA, 275 bp, Glycine max
caaaccccaaaaaaagaaaagatgaaagcaatgaaacgctgctcttcatcatcttcctcttcttattcttctgcttctgagtccaccccacaaagcaatcaaaataaaaatagtaataacttttgctacaaaataaaaggcccatggagtgccaaggaggatcggattctgaccggcctcgtggaggcccatggcccgagaaactgggcctcgataagccgtcacattaagggtcggtccgggaagtcctgccggcttcggtggtgtaaccaact

SEQ ID NO: 2701 - DNA, 271 bp, Glycine max
  unsure (1)..(271): unsure at all n locations
ctctntctggacncaaganttaagttntnagatngagagaagtagngaanatgagatgtnaataanganaggtccatggacagagcnagaggattctcttctcttcaattacatcnnnntccacggcgaaggncactggaactctgtcgctcgctacacaggtctaaaacgaacgggcaaaagctgcagattaagatggttgaactacttgcgtccanatgttcgangtgggaacataaccctccaagaacngctcttgattctttncctc

SEQ ID NO: 2702 - DNA, 372 bp, Glycine max
aatcataacagcaacaacccctatcaacctggtgcagaacaatatcacatgttggagtcggcacattcatggcctcattctcagttcaatgttgcttgtcactatagccagtcttttggggacaataatgttattttcccacaggggggttttggtggtggctatggcaataaccagtacccttaccagttttttcatggccctggtgatacgttgatgaggttggggccctcggcgacgaaggaagcgaggaagaagagaatggcgaggcagagaaggtttctgtctcatcacaggcatcataatggtaatcaccagaattcagggtcagacccacatgcaagattggggggtggtgataattgcaccact

SEQ ID NO: 2703 - DNA, 323 bp, Glycine max
  unsure (1)..(323): unsure at all n locations
gaggnccaccggccctataaggcgtgctaagggcggttggnctgcncaagnagatgagacattaaggaatgctgttgcngttttgaagggaaagagttggnagaaaatagctgagttttttcctgatagatcagaagttcagtgtctgcacagatggcaaaaagttcttatccagaacttgtnaanggnccttggacacaggnggaggatgataanattgttgaactggtgtcaaantatgggcctacnaaatggtctttgatagccaagtctttacctggtcgaataggcnnacaatgncgagagcggtggcncaatcntct

SEQ ID NO: 2704 - DNA, 295 bp, Glycine max
  unsure (1)..(295): unsure at all n locations
gttgacaagaggcagaaacaattgctgaacttctttgagaaggctcttcagaatcctactttcgttgaacatctttcacgcaaaattgagtcnatggatttatctgcatataaganaaggagattgcctcaggttgatcacgtgcaaccagttgccgaaagtagctggggacaatcaagcattttagatggatttggaaagtttcggcagttttcgataactcgatggatgtcacgcgttcnaagactggaccgacccgatcatgagtgggaacccaaaangcnagaacaagnca

SEQ ID NO: 2705 - DNA, 242 bp, Glycine max
  unsure (1)..(242): unsure at all n locations
aacaattctgagagatggcaaccacgaacccttttgatttgttgggtgacggcgctgaggacccttctcagctcatcgccgccgagcaactcaagnnnnnnnnnnnnnnnnnnnnnnnnnnnnncgctcccaagaaggcgccggctcagcagatcaagccggctcagctccctagcaagcctcttcctccggctcaggctgtgagggatgccagaaatgagtctgttcgnggaggccgtgga

SEQ ID NO: 2706 - DNA, 248 bp, Glycine max
  unsure (1)..(248): unsure at all n locations
cagcaatgggncatgaagatgaacccctcgatgaatttattgaagcacanagaacctgtctcaatgatcttatgtacnttcctacccgtaatgcatatggtctctctagtgtngctggaaacatggaaaagctaacagctttgcagaatgagtttgagaatgtganaagcaaattggatgatgataaggagaagacggtacggcttgagaagaaggtgatggttctcacacaaggctatgagatgaga

SEQ ID NO: 2707 - DNA, 275 bp, Glycine max
  unsure (1)..(275): unsure at all n locations
aatcatgacagattgtgtcatcttcaattgacaaaatgccgtgtaatgcgaatagcagtcaggtgtccacaacttgaaactatgtcgttgaagcgcagtaacatggcacaggttgtgcttaattgtccacttttgcatgagcttgatataggctcttgccacaaacttcctgatgctgcaatacncgctgctgcaacttcatgtcctcaactgtctcactggacatgtcaaattgttcatgtgtcagtgatgaaactctgcgtgaaatcgcgttg

SEQ ID NO: 2708 - DNA, 246 bp, Glycine max
  unsure (1)..(246): unsure at all n locations
tattcatattgttgatcatatngatttagatgtctggagtgtacctgaagtactgaggccgctgtatgaatcatcaaaaatcttggctcagaagttgacaattgctgccttgcaacatataagacagaagcactagaatcaagtggagaaattcagtatggtggtggacgccagcctgctgttttaagaacatttagccagagactttgcaggggctttaatgatgctgtgaatgggtttgttgat

SEQ ID NO: 2709 - DNA, 271 bp, Glycine max
  unsure (1)..(271): unsure at all n locations
ttgggaaaacaaataattctgagagatggcaaccacgaacccttttgatttgttgggtgacgacgctgaggacccttctcagcttcatcgccgccgagcaactcaaggngnnnnnnnnnnnnnnnnnnnnnnnnnncgctcccaagaaggcgccggctcagcagatcaagccggctcagctcctagcaagcctcttcctccggctcaggctgtgagggatgccagaaatgagtctgttcgtggaagccgtggaggtggacgaagtggggga

SEQ ID NO: 2710 - DNA, 285 bp, Glycine max
  unsure (1)..(285): unsure at all n locations
attcacttgggcatttttatccagggattccgcaagattgacactgaaaaatgggagtttttcaatgaagctttccagcgaggaaagagacatcttctgaagaacatccggaggcgcgggccacctcagtcccatcaggttggtggcaatattgtgccttattccgatgcagataaggccgggcttgaatttgagctagaaagtctaaggaaagaaaggagtgtgctaatgcaagaggtggttgagttgcnacaacagcagagaacgacacttcaacgtgcgaga

SEQ ID NO: 2711 - DNA, 205 bp, Glycine max
  unsure (1)..(205): unsure at all n locations
cttcacactaattcagagcnncacatgaacncaaatgatgctaactctcctaagccgttggagatnntgcagatgagtcctgttcctccgtttttgtccaagaccttcgacctcgtcgacgacccgactctcgaccccattatctcatggggctccaccggttttagcttcgtcgtgtgggaccctctcgagtntcgtccttcct

SEQ ID NO: 2712 - DNA, 260 bp, Glycine max
gtgcttaggagtttgagggtcgtgtaatcaaagtcaattatgctcggccgaaaaaggagaaaacgccgccccctgtgaaaccaaaggtggtgacgtttaacttgtttgttgccaacttgtcctatgaagcgagcgccaaagatctcaaggagttttttgattctggaactggtaaagttgtgtctgctgaggttgtgtatcgtgataatcctagaaggccgtctggttatggatttgtgtcctacaagtccaagaaagaa

SEQ ID NO: 2713 - DNA, 220 bp, Glycine max
  unsure (1)..(220): unsure at all n locations
ggtttggagaanatagaatctctggcttcactctcttcactgctgtgggtggtnnctgatnccaaaccctnttggttttggcaccatggaaaacgaacacactttggcggttgctgacanaganatgtggctgaacagtgaccaatacgagttcctaggagtcnatgntnnttccntgttctacgccganntccctcntctccctgatttcccttgcatg

SEQ ID NO: 2714 - DNA, 272 bp, Glycine max
agacagggtgaatgatgttttctgggaacagtttcttaccgaaaggccaggctgttctgacaatgaagaggcaatgtccaactaccgagcaaacccgcatgatgaacaagacgaagggcggtcagctcatggaatctctagaaacattaagaacatggatcaactcacactttgagttgggcatgctgtcttagagaacagttaaactatttttatatgaatttttcatgactaatatacaatatgatctgaaacttcacagttgacagttg

SEQ ID NO: 2715 - DNA, 251 bp, Glycine max
aagaaacatgagatgctactggctgaaattgaatacttccagaaaagggagattgaactggaaaatgaaaatctttgcctccgaactaagataactgacgtggagaggattcagcaagtaaacatggtttctgggccagaactgaatgccattcaggcattagcttcccgtaacttcttcaatccaaatatgttggaaggtggaactgtttaccctcactcagataagaagattcttcatcttgggtgatc

SEQ ID NO: 2716 - DNA, 225 bp, Glycine max
aggaaattatggacaagaccaccaagcgttgcaacattcttcatcatctgcacctttggtgcgtgatgattgccttacacaggctccacaactggaacttgttggccactcaattggatacgctccttttataggaatgtctcatgccagaatggctttgccccttgagatggctcaagagcctgtttatgtgaatgccaaaaataccaaggaattctgagacga

SEQ ID NO: 2717 - DNA, 260 bp, Glycine max
aagggtgtctctgaaattgtcatgtccacgttaaggtcttgattggctttctgggtttggagaagaatctctgcttcactctcttcactgctgggaggtaactgacccaaaccctattggttttggcaacatggaagatgaacacactttggcggttgctgagagagagatgtggtgaacagtgaccaagacgagttcctaggtgtcaatgatgcttccatgttctacgctgatttccctcctctccctgatttcccttg

SEQ ID NO: 2718 - DNA, 222 bp, Glycine max
ccacaaggtaggctggaccccgaagttatagatcttcttttagagcttgctgatgacttcattgattctgcaactacacatggttgcattttggcgaaacatagaaaatcgtcaaatttggagtccaaggatttattgctacacctagagaaattggggatttaacaattcccggatactcaagtgaagagaaggagaatcagagcaacctcaattaaatga

SEQ ID NO: 2719 - DNA, 251 bp, Glycine max
tcaagcgcctttgctggcaccagagagaaatgtgttggatgcagcaagacagtctatccaactgagagggtcactgttaacaacactatgtaccacaagagctgcttcaagtgctgccatggagggtgcaccatcagcccttctaactacattgcgcacgaggggaagctgtactgcaagcaccaccacatccagctgatcaaggagaaggggaacttcagccagcttgagaatgaccacggaagacatca

SEQ ID NO: 2720 - DNA, 277 bp, Glycine max
ctcgagcgaatcggctcgagatatagatagatactcatgttatacatgcgaattcgtcaactaacaacacatttccacttattcttctcatttcattcttcttccttcttttgtcttcccttagcttagtttgaagatcatggggagaggaagggttcagctgaagcagatcgagaacaaaatcagccgccaagtgacgttttccaaaaggagaactgggctgcgaaagaaagctaatgaaatctctgtgctctgtgatgctcaagtggcactgatt

SEQ ID NO: 2721 - DNA, 257 bp, Glycine max
atcaattttatggactcttctcagcttatgcacctcaaatttcgggacgtataatgctgccacttaacatgacatctgatgatgaaccaatttacgtaaatgctaagcagtaccatggaatcattagacgtcggcagtcccgtgccaaagctgtacttgatcacaaattgactaaacgtcgcaagccctatatgcacgaatcacgccatctccatgcaatgcggcgaccaagaggatgtgggggtcgcttcttgaac

SEQ ID NO: 2722 - DNA, 237 bp, Glycine max
tcatgtcggagatcgaacacatgaagaagctttacaacggcattatctacttcgttcagaaccatgtcaagcccgtggctccaagcaacaacaacactttcccttcttttctactctgcagtaataacattatagcaatagcaacaacaacacatcatcacaaccacaagcctctcctatgagcaatgtttcaacgttgcaaaggcaagtgaagcaatttctggggtgttactccaa

SEQ ID NO: 2723 - DNA, 172 bp, Glycine max
cgctgatctgtcgcaagccaagcactatcaccgccgccacaaggtgtgcgagtttcactccaaagccgccaccgtcatcgccgccggcttgactcagcgattctgccagcaatgcagcaggttccatcttctttctgagtttgataacggataacgtagctccagcaggagt

SEQ ID NO: 2724 - DNA, 242 bp, Glycine max
gacgaacacgttgaatgtgaaactcagagctggtaccaagaagtttcaaagctaaagtgaaagtatgagtctcttcaaaggacccagaggcatttgcttggggaagatcttggaccattgaacataaaggagctgcagaatattgagaaacagcttgaaggggctttagcacaagcaagacaaaggaagacacaaatcatgattgaacaaatggaagagcttcgcagaagggagcgccatct

SEQ ID NO: 2725 - DNA, 105 bp, Glycine max
gcggcgccttcccgtccggtaccggcacgggcctcacagcgcttgtggaggattctaactgctggcggtttaaaccagaagcataattggtcatcatatagagta

SEQ ID NO: 2726 - DNA, 244 bp, Glycine max
ttcatggcgaacccagaaaccgacgaagtgttcgcgaactgagtttgcttcctctcagaaactcggaactcggtgctgactcggacggtgctggtggtgatgacgtggcagaaccttcttgttgtgaaagcctgcgtctttcgctaagactctgactcagagcgacgccaacaatggtggggtgttttcggttccgcggtactgcgcggagacaattttcccgcgtctggactacacggcggag

SEQ ID NO: 2727 - DNA, 266 bp, Glycine max
cttcatcttcagcaacaccacttcccgtgaagaccatgacatgttccaccagcagcaccatcctgactactacctcttccacttcttgggccatgttgaagtcagatgctgaggaagatgcagagaaaaaccattgcaaccgatacatgcatgaccaacttgatgcaactttgtcttccaccgcttccatggagctttctcaacagcaaaaccctgatcctggccttggtggcactgttggagagtgcatggatgatgttatggac

SEQ ID NO: 2728 - DNA, 258 bp, Glycine max
agcacatccctcacagtggcatgccttgtggatgggtgcaattcagatcttagcaatagtagagattatcataggcgccataaggtgtgtgagctccattccaagaccccagaggtcacaattggtggcttcaagcaaaggttctgccaacaatgtagcaggttccattcgctggagcaatttgatgaaagaaaaagaagctgcagataacgtttagatggacacaatagaaggagaagatagcccagccagaacctc

SEQ ID NO: 2729 - DNA, 259 bp, Glycine max
ttgaaatggaagaggagcctgtttatgtcaatgcgaagcagtaccatggtattttgaggcgaagacagtcacgtgctaaggctgagattgcaaagaaagtaatcaaaaacaggaagccatacctccacgaacccgtcaccttcatgcaatgagaagggcaagaggcaacggtggtcgctttctcaacacaaagaagcttgaaaataacaattctaattccacttcagacaaagctcccaatactcgtgcaaacccctca

SEQ ID NO: 2730 - DNA, 259 bp, Glycine max
ctcgagaacactggtgagcttctttgctttgaatttggctccacacaatagttaatgacctttcgtttttccaccactttcattttcaaggaacatggtttttcatacacacatccatatttccttgtgcaggtgactttgtgagagccaatggactccaagagggagatttcatagtgatatactcagatgtgaagtgtggcaaatatgtaagaccctttcttattttccatttttcattttcttaacatgttttgag

SEQ ID NO: 2731 - DNA, 240 bp, Glycine max
agttaagaatttcgtggggttgtctgtatctgatggttacattgctactggttcagagacaaacgaggtgttcatataccacaaggcttttcccatgccagcattatctttcaaattttacagtagtgaccctctttttgggaatgaagaggatgattctacacagttcatcacttctgtttgttggcgcggtcagtcctccaccttacttgctgcaaattccacaggaaatgtcaaaat

SEQ ID NO: 2732 - DNA, 257 bp, Glycine max
atgcaggacacaattgaacgctaccgcaggcataacaggagtgctcaaacagtgaacagatctgatgaacaaaatatgcagcatttgaagcaagaaacagcaaacttgatgaagaagattgagcttcttgaggcttcaaaacggttcaagatcttgcttttcaatccatcttcgcaacttgtttatattcactgttagatttatctcacaaagaatacaaataaaaaatatattctgtgtactattcatccctcagg

SEQ ID NO: 2733 - DNA, 261 bp, Glycine max
aaaagactcaacgacgtcgtaacgggactcagcactcgcgcttcttcgttttccttctcgatgcactgtttcttgaaagggtgaagcgtgtcaaacaaggaagagtgacgtttcgccggcggagacccgatgaggaggaggatgactccaccgcgcgacggcggcggagagtggagttccagtggttcttgatggcgttgtcggtgcggccggggaggaggcgcgagatggtggcccatttgtttccgtgaactcgcttta

SEQ ID NO: 2734 - DNA, 248 bp, Glycine max
ttgcggctgagttaccaggaagaacagataacgaaataaagaaccattggcacaccacactcaagaagaggtctcaacaaaacacactcacaaaggaagaagctagagcctccaaatcaaaggataaggtacttcccaacaagggtgttactgttactcttccagctacttcttcccagatttcagataattcatcattatcgccagcttcatccaccagcagcgagttttccaacataacttcagat

SEQ ID NO: 2735 - DNA, 120 bp, Glycine max
gcacaaacagataacattgagacacccgcatgcctcataagtcgtcagcaagtgaagtatggttgctttattaaatgtgtgggcaggttctgcattgatgctgactgacttttattgtat

SEQ ID NO: 2736 - DNA, 188 bp, Glycine max
atcaagtgttcgccgatacatgggtaccataactggtattagtgatttagagggagtccgctggccaaattcacactggcgttctgtgaaggttggctgggatgagtccactgcaggggagaggcagccaagagtttccttgtgggagattgaacctttgacaacattcccaatgtatccatctccat

SEQ ID NO: 2737 - DNA, 211 bp, Glycine max
ctcttcacatcctccatattgcaagcttttttgggccttcaaatcttgcttggagaatgctcaattttggtggaagcctctcacacaagatagcatagtttcttttgggttcattctacttggtgtttagagatggtgagaggaaagactcagctgaggcgcatagagaacgccacaagcaggtttgtcaccttttcaaagcggcgtaatg

SEQ ID NO: 2738 - DNA, 250 bp, Glycine max
tatgtctatggctgatgttggtgctggaggtgaagatgccattgttacatttgagggtattgctatccttacgccaagaggacgatacagtgttgagttacacatgtcattcttgcggcttcaagacaggctaatgatttcaaaatccaatatagcagtgtggttcgcctatttttacttcctaagtctaatcaaccacatacctttgtcattattagtcttgatccccctattcgaaagggacaaactt

SEQ ID NO: 2739 - DNA, 264 bp, Glycine max
tgatcctgttgggaaggattctgtcgatatggcaaaaaatcttcctagggaaatgctgattaatcttttgaattgtttggaatcaacctttgcgatatgtcttgtttgcaacgatcctcctgaagagcctgttattacgatgtgtggtcatgtcttctgttatcaatgtgtatcagaatatttgactggtgatgataatacgtgcccgtcagttaattgtaaagaactaattggcgatgatcttgttttctccagagcgacttt

SEQ ID NO: 2740 - DNA, 268 bp, Glycine max
ctcagtttaccatctttccaggtatctcttcttcagatgattgtaagatgtcaggtgatgcacaaaatcctcaggcaacattatcactgcaatcatcactggctgagccccacaatcgttttgagataggggttaatcagcctatgatctgtgcaaaatatccttatatggatcaattttatggactcttctcagcatatggacctcaaatttcgggacggataatgcttccaattaacttgacatccgatgaaggaccaacttacgt

SEQ ID NO: 2741 - DNA, 248 bp, Glycine max
aaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtg

SEQ ID NO: 2742 - DNA, 258 bp, Glycine max
ccagcttcagaagaagctttatataccgatgaaagaataccctggttacaatttcattgggcttattattggtcctcgaggtaacacccagaagcggatggagaaagaaactggtgctaaaatgtgattccggggtaagggatcggtgaaagagggtaggcttcagcagaagagggatttgaaacctgacccttcggaggctgaagatttgcattgttagttgaggcagagacaccggagtcgcttgaggctgctgcg

SEQ ID NO: 2743 - DNA, 266 bp, Glycine max
gctaagtggaaagaaagaaagaaaatttcaagggctgaaacatctatctttaattgtatcctccctttgtttcctcacaaggttgcaagcatggcttttccaaacccatccatgtcagtttctccacagaagaagatgggaagggggaagattgagatcaagaggattgagaacaccaccaatcgccaagtcaccttctgcaagcgcagaaacggcttgctcaagaaagcatatgaattatctgtgctttgtgatgcagaggttgc

SEQ ID NO: 2744 - DNA, 243 bp, Glycine max
gtactattcaaggttacaagaaacttcaagcagttttaagggccataatgctacgtcgtacaaaaggaactttgcttgatgggaagccaataatcaatttgcctcccaagacaattgagctaagtaaggtggatttttcgattgaggagcgagcattctacaccaaattggaatcagactcgcgtcttcaatttaaggcatatgctgctgctgggacagtgagccaaaactatgctaatattc

SEQ ID NO: 2745 - DNA, 265 bp, Glycine max
cagagatgcttcttgagatgcagaaaaatgaaatgaaaaggcatgaagcttggctggtttatggagccttgctggtcagtgtatatatgatcgactaaagattttcccaacttttccatctcctccccttcatgctgtctggaagaccaatgcaaaagttcttacttcaactcataaacgcaaggcaagccctgagcaattggaacagcagccacctttgaaaaaagctgctacggatggtgagattggtgtggacctaatgaat

SEQ ID NO: 2746 - DNA, 275 bp, Glycine max
tctcgagcgattcggctcagaggacttcaagagggatgacctcaggattgatactatcccttctacatcaatggatggcatcaaggagtggcttgacacaacagacatcaaatattatgagagcaggctgaatctgaactggcgtcagatcctgaagacaatcacggatgaccctcagagctttattgaaggtggtggttgggagtttctgaatttggaagctactgattcagaatctgagaactcagaggagtcagataaaggttacgaaccat

SEQ ID NO: 2747 - DNA, 267 bp, Glycine max
tcaatttccaatttccttaatcttgttgtgttgatgtacatggagagaattagagtgaaggaggaagaagcagtgacatgtggtggtggttcatcatcatcatcatcttcgtcttcaagcttttctccacagcctatggaagggttgcacgaggtgggtccccctccgtttctgagcaagatctttgacatggtagaagattcttccacggactccattgtgtcatggagcatggctcgcaacagctttgtggtgtgggattctcac

SEQ ID NO: 2748 - DNA, 343 bp, Glycine max
agagttattatcccaatttcctttcttctgtggctaatgctatatcagcgaaaagcatgtttcatgttttctacagtccaagagcaagtcatgcggattttgctgtgccctaccaaaaatatatcaaaagcatcaagaatccagtgaccatcgggacaagattcaaaatgaaatttgaaatggatgaatctcccgaaagaaggtgcactagtggcatagtgactggaatgagtgatttggatccctataaatggcctaagtcaaaatggaggtgcttgatggtcagatgggatgaggatattgagattaatccatcagatagagtgtctccctgggaggttga

SEQ ID NO: 2749 - DNA, 384 bp, Glycine max
ggctcgatgaagaagactcttgcacatagcttcaaagaaattaattaagatgggtcaccattcttgctgcaaccaacagaaggttaagagaggcctttggtcccccgaggaagatgagaagctcatcagatacattaccactcacggctatggttgctggagtgaagttccagagaaagctgggcttcaaaggtgtggtaagagttgtcgcctgagctggattaattccctgaggcctgcgcttagaagaggcaggtttacacctgaagaggagaagttaattataagtcttcacggggtcgttggcaacagatgggctcacagtgcaagccacttaccaggtagaacgtgacacgaaatacagaactgactggattcttggat

SEQ ID NO: 2750 - DNA, 360 bp, Glycine max
agacctgctcgctaggcccgtcacgtgctccccacgtgacatccagaccgcggccacggccgcgcctccatggttaagttcgaccctgtgacacaatcctcagactcggagactcacgagtcttcggagctgagcgagattgtcgaacttcccaacattgaagagcgcagcgttgactcgacaccggagttcgtcttggtcgatgttgtgacagttgggtgtttcccccaatgggaatgggttcagagggaatcgagttctgtgccgctttttctgatgagttatttccgcaacagagttttattggttccgagatagagatactaccatttgggattgaatggtgagtgggattcatgt

SEQ ID NO: 2751 - DNA, 264 bp, Glycine max
caaagacgagaaggaggcagcgttgaatctttgctaaatacctgtgtgtcaaagttcaaattattgcgagttttggatttaaggaattcgacatgcaagactttgccacgttccattgatagttgaagttgtttgctgcaggttgactccactacagtcaaacctatataaacattttatacaatccaaaaatgttaagcgggcaattactgaagaactgaagcaatcaaagattttggcctacgtaacagctctcaaaaagtt

SEQ ID NO: 2752 - DNA, 255 bp, Glycine max
tgggaagatccccttgttgcgagagagaacacaccaacaaaggagcttggaccaaagaagaagacgaacgcctcatcaactacatcaagctccatggtgaaggctgttggagatccctccccaaagctgctggcttgctcagatgtggcaagagttgcagactcagatggataaattacctcagacctgatctcaagagaggcaacttcactgaagagaagatgaactcatcataaacctccatagcttacttgg

SEQ ID NO: 2753 - DNA, 269 bp, Glycine max
cttaaacgtatataggattgaggtgtatactcctcagaggcaaagatgagtggtgttggatatattgggtccaagatcagcctcatatcaaagtctgacattcgttatgtgggcatattgcatagcatcaattcagccgattcaaccgtagctcttgaacaagttcgttcttatggaacggagggccgccgaggaagtcctgcagaggaaattcctccttctgacaatatttttgaatatatagtgtttcgtggttcagatgtaaaaga

SEQ ID NO: 2754 - DNA, 273 bp, Glycine max
gcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggag

SEQ ID NO: 2755 - DNA, 257 bp, Glycine max
cttgattctgcaactacacatggttgtgttttggcaaaacatagaaaatcgtcaactttggagtccaatgatttattgctacaccttgagaaaattgggatttaaaaattcccggatactcaagtgaagagaagaagaatcagaacaaacctctattaaatgacctccacaagaggcgcctagatatggttcgcacattgatggaatctttgccctctgagtcgagtgttaacagttctaaagagatgagtatacag

SEQ ID NO: 2756 - DNA, 219 bp, Glycine max
ctcgcttcagcataataatattatcgcctgcatccacagtaacagtaccctcctcttcttcatcatttcatggaggattcttcagctggtgaagacacaagacttgccctcgtggccactggagacccgctgaggatgaaaagcttagacaacttgttgaacaatatggtgcccaaaactggaattcaatcgctgaaaagctccaaggaagatcaggga

SEQ ID NO: 2757 - DNA, 255 bp, Glycine max
gaaaattaaacatgggaagaggaagggttgttctggaaagaatagagaacaagatcaaccgtcaagtaacattctcaaaacgcagaagtgggttgctgaagaaggcctttgagctttctgtgctatgtgatgctgaagttggccttatcatcttttctagccgtggcaagctttttcagtacagcagcactgatattaccaaaatcattgagaggtatcgccaatgtcgttacagcaagtcacacactggtgatt

SEQ ID NO: 2758 - DNA, 261 bp, Glycine max
gggagagggagggttcagctgaagcagatcgagaataaaatcagccgccaagtgacgttttccaaaaggagaactgggctgcgcaagaaagccaacgaaatctctgtgctctgtgatgctcaagtagcactgattgtgttcaatgctaaagggaagctttttgagtattcttctgaatccagcatggaaaacgtgctggaacgatatgagagacatgcccatataggacaacttgttggagacggagatgattcacaggga

SEQ ID NO: 2759 - DNA, 253 bp, Glycine max
ataagataagggtggtgaatgtgaaaatagagggagcatgtggaatggttgtggtcactattatatatgttgtctcttagggtttgcatgtgactttctttctttctttatatcctttatatattaagtatatgctgcaatatatttagttaaagagagaagtaacatcaaggtgcagagagaggaattgaagcatgggaagagggaaggtggttctggagagaatacagaacaagatcaatcgccaagtaac

SEQ ID NO: 2760 - DNA, 254 bp, Glycine max
ccagcgttcattttttctcgcgcccaaatacaaaatcacatcacaacagggttccggcgaccatgtctgatgctccggcgagtccatgcggcggcggcggcggaggcagccacgagaccggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaa

SEQ ID NO: 2761 - DNA, 247 bp, Glycine max
ccagcgttcattttttctcgcgcccaaatacaaaatcacatcacaacagggttccggcgaccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgt

SEQ ID NO: 2762 - DNA, 247 bp, Glycine max
cagttatcgagcgagaacgagaaactgaagaaggataacgaaacgctgagttgcgagctggcacgtgcgaggaagcagtgcgatgagctcgtggcttttctcagggaccgtctgatggtgggtcccgatcagatcgatcgcatcatgcggcaaggaagttgcggatctgaaaacgcggtaggtgaaggcggtgatggaggacactgtttgaaactgtttggtgtttggttaaaaggggatacactaa

SEQ ID NO: 2763 - DNA, 337 bp, Glycine max
atttggtgaaaatgacagaaggcacgtgacttgggtggggacacgctgtactattagcgctgcgacgctgccattgattgggccatgtatgtaatgtaacattacgctagatggaaagggcggatgaccatccttgtatgtaactcgcggatgggatgaaaagtgtcgaagtcaaagctttgcttgagcgccaaaatttgtaatataaggatttatgtattcttgataagctggggttaaagaacatgtcaaaatggagtaactgaagcaacccctaaaagattcacttctcgttttcctttttaaggaacatttgtgggttacagcaaaatatgta

SEQ ID NO: 2764 - DNA, 241 bp, Glycine max
tgggatctgacaaggataagcgcaaagatgctttggagaaggaggagaaatccaagaagtctgtcaacatcactgagtttctgaagccagctgcagggaaaggtactaccctggtgggcgtagtcggcgacgttgccgtggttctagaggaggttacagtggaaatgcatacagcaatgctccagctccatcagttgaggatcctgggcacttcccatccttgggtggcaagtgaggtttt

SEQ ID NO: 2765 - DNA, 256 bp, Glycine max
attccccctaaccaagtttaagtttctagaatggaagaaatgaacagaagctcctcctccacttcctcttcctctcactgttgctctttagagtccaaccataggagccccaacaagccagacagaatcaaaggcccatggagcgcccaagaggatcggatcctgacacgactagtcgaacaatacggccctcgaaactggtccctcatcagccgctacattaagggcaggtccggcaaatcgtgccggctgcggt

SEQ ID NO: 2766 - DNA, 238 bp, Glycine max
ctcgagccgaatcggctcgaggcgaagacgacaccaccttcgtcacttggcgtcctcctgaattcgccagagaccttcttcactaactacttcaaacacaacaacttctccagcttcgttcgccaactcaacacctatggttttagaaagattgtgccacaccgatgggagttcgcgaacgaattcttcaagaagggagagaaacacttgctgtgcgagatccatgaagaaaaacggc

SEQ ID NO: 2767 - DNA, 252 bp, Glycine max
gcagcacctgaagcacatcctcttctggttgctaaagaggaaactaacgcgctaaaacaagaaatccaaacattgcaaaagggtatcagttatttgtttgaaggaggaaataagactatggcaattgatgaatacaactgctagagaagaatctcgaaacttggatatatcatattcgttcaatgaagatgaacattatgttacaagaaattcaagctttgaaagataaggagggaacactcaaagcggcaa

SEQ ID NO: 2768 - DNA, 246 bp, Glycine max
tctcgagccgaatcggctcgaggctagccaatcctaattcctatatctatccttattactacataactctaaagtaagtaagaaaaatagagcaatttcacaacacaacacaactcttataattgtgtagttattaattgagtatgggaaggtccccttgctgtgagaaagctcacacaaacaaaggtgcatggactaaagaagaagatgacagactcatatcttatattcgagctcacggcgaag

SEQ ID NO: 2769 - DNA, 251 bp, Glycine max
ctcgagcgaatcggctcagtatgattctgccagcgtgatatatatgtgcagttggagctcgatataagagttattgctcaaacatagctcggacattcttgattgatgcagatcctcttcaaagtagggcttatgaggttcttctgaaagcccatgaagctgtcataggttctatgaagcctggaaacaagttaagtgttgcataccaagctgcagtttctgttgtggaaagggatgctcctgacctgatt

SEQ ID NO: 2770 - DNA, 242 bp, Glycine max
cagaaacccatttgccagagctggaggcaagagatggaatttccataacaatggaagacattggaacttcacgtgtttggaacatgcgctatagatactggccgaacaacaaaagcagaatgtatttgctcgagaacactggtgactttgtgagagccaatggactccaagagggagatttcatagtgatatactcagatgtgaagtgtggcaaatatatgataagaggagtgaaagtgaga

SEQ ID NO: 2771 - DNA, 133 bp, Glycine max
agcgaattgaactgtttgatcaaatggatgatccacttgattagattgagatggatgaactatctgagaccagacatcaagagagggaacatagcaccagacgaagatgatcttataatcagtatgcattcac

SEQ ID NO: 2772 - DNA, 251 bp, Glycine max
ctccagttactcactgaagataacattggaagcattgggcaataaaaatgagcaattcctctgctggaacctcatcaaaaccaagaacagcttcctcacaaccatcagaaacttcgtccaagcgcaaagaggagttttccaaaaagaattgcagcacatgatgtatggctttggagatgatcctaatccacttcctgaaagtgtggctcttatggaggacattgttgtggagtatgtcacagaactggtac

SEQ ID NO: 2773 - DNA, 252 bp, Glycine max
acttgatcttagtgaggagcccatgtatgtgaacgcaaagcagtaccatgctattctgagacgcaggcagtatcgtgcaaaactggaagcacagaacaaactcatcaaagaacggaaaccatatcttcatgagtcccgccatctacatgcactgaagagagctagaggttccggtggacgctttttgaatgccaaaaagctccaagagttgaaactcacttcagcaaaccgtggcctagatgtttctggctg

SEQ ID NO: 2774 - DNA, 248 bp, Glycine max
catcaacctgtttttcctccattcagtcggaagacaaatcactaacattctttcctcatgacaattttttactactcgtaaaacaactttcttttccttttacccttttcataggtgtatgagttgtgtttgtcttgcagccttatatgcatgaatcacgccatctacatgcgacgcggcgaccaagaggatgcggtggtcgcttcttgaacacaaaaagctctactgatggaaatggtaaaaatgaa

SEQ ID NO: 2775 - DNA, 247 bp, Glycine max
tcatgaacaaggtccgcgacgagtttgtcaacaacggtggtcccggcgacgaattctcaaggagcttcaatctatatgggaatcgaagatgatgcaagctggtgccattgttggtcccatagaaaggtccggggcgcctaagccaacgcccggtggtccaattactccggttcatgatcttaacatgccttatgaggggactgaggagtatgaaactcccacagcggaaatgcttttcccccctacg

SEQ ID NO: 2776 - DNA, 261 bp, Glycine max
agaaggcgacgctcgaaatcgcggcgtggcggctaggcggaggaaaagaagccatgaagcagttgctgaagctgattcttgagtgggttcaaaccagccatcttcagaataagcgccgaaaggagaataatggtagtagtattagcagtgtacttcaggcacagtttcaggatcctagtggccagaacacacaaagtggttcatttgcacctgaatcaaacacttgtttcaacaaccaaacaccatggttgagttctcaaa

SEQ ID NO: 2777 - DNA, 242 bp, Glycine max
gtccgttacacgcctgagcaggttgaagccctagaaaggctctatcacgattgcaccatacctgcttccattcagcgccagcagctcattcgcgagtgtcccattctctccaacatcgaaccccagcaaatcaaggtttggttccagaacagaagatgtagagagaagcagagccaggagtcgtcgcggctccaagctgtcaataggaagctgactgctatgaacaagctgctgatggaaga

SEQ ID NO: 2778 - DNA, 251 bp, Glycine max
agcagagctgttcgacgacaacgaaagcgatcgcaacgacgacgacgttttgagcgagagcaaggactcgggagtgacgacggctcacgcagtgaaagaagagatggatgacggcgccgctaactggtcgacgtcgtcgtcgacttcgcccaaaccgatggaagggttgcacgaggtgggcccccctccgttcctgaagaagacgtttgaaatggtggaggaccctcacaccaaccccattgtgtcgtgga

SEQ ID NO: 2779 - DNA, 229 bp, Glycine max
caagaaattgagaaggttactgattttaacgaaccacagtcttcccctggcaaggatcaagaagattattaaggctgacgaggatgttaggatgatatcagctgaagcaccagtcattttggcaagggcatgtgaaatgttcatattagagtgaaccctgcgctcttggaatctcactgaagagatcaaaaggcgaacacttcagaaaaatgatattgctgctgctatc

SEQ ID NO: 2780 - DNA, 246 bp, Glycine max
gtttcggtggtggaggctatggcaatgaccagtacccttatcagtttttgcatggccctggcgataggttgatgaggttggggccctccgcgacgaaggaagcgaggaagaagagaatggcaaggcgcagaggtttctgtctcatcacaggcatcatagtggtaatcaccagaatcaagggtctgaccctcatgcaagactggggggtgataattgcaacactgctttggctgcgcctcatcacgc

SEQ ID NO: 2781 - DNA, 232 bp, Glycine max
ctcaagcaagggctcatagaattggtcaaaagagggatgttcttgttcttcggtttgaaacggttcaaaccgttgaagaacaagtcagggcttcagctgagcacaaacttggcgttgctaatcagagcattactgctggttttttcgacaataatacaagtgctgaagatcgaagagaatacttggaatcactcctgcgtgagtgtaagaaagaagaggttgcacctgtttt

SEQ ID NO: 2782 - DNA, 300 bp, Glycine max
atgcaaggacccgttttacaatcatcaaaaccagatatggaattttatagagcgcttgaaggaatttttggtgatcagtcagtgcctcaccagtgtggccatggctgctgtgctgctccaaatggtagaaagtccgaaagctctttgttgggaccagaattcattgaattttcggaacctccatctttcccaaattttgagttgtctgcaatagctacagacattagtaaccttgcttggcttaaaagtgggttggagagtagtagtgtcaaaataatgggcaacacctctggcagggta

SEQ ID NO: 2783 - DNA, 244 bp, Glycine max
cagagagaggaattgaagcatgggaagagggaaggtggttctggagagaatacagaacaagatcaatcgccaagtaaccttctcaaagcgcagaaatggtttgctcaagaaagctttcgagctatctgttctatgcgatgctgaaatcgctctcgtcatcttctccagccgtggcaagctttttcagtatagtagcactgacattaacagaatcattgagaagtatcgtcaatgctgcttcaac

SEQ ID NO: 2784 - DNA, 203 bp, Glycine max
tttcaatgaactcattgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaattagt

SEQ ID NO: 2785 - DNA, 257 bp, Glycine max
tgcgattgcgatggtgaaatcgaacgagaacggttctggttccgtttcggtggctccgttcctgaaaaaatgttacgatatggtggacgaccgcaacactgattctatcatccgttggagcgatggcggtgacagctttgtcatctccgacatcactcaattctccgtcacgctccttcccacctatttcaaacacaacaatttctccagtttcatcagacaactcaatatctatggtttcaggaaaattgatacgg

SEQ ID NO: 2786 - DNA, 250 bp, Glycine max
gggtagatcgggaagaaaaaaaaatgtcacagcagcagcgttcgacgccggcgccgttcttgacgaagacgtatctgctggtggatgaccccgccaccgacgacgtcgtttcgtggagcgaaggtggcaatacttcgtcgtttggaaacacgccgatttcgctaaggacttgcttccgaagtacttcaagcataataatttctccagcttcgttcgccaactcaacacctatggatccgaaaaatgttcc

SEQ ID NO: 2787 - DNA, 265 bp, Glycine max
cctcggcgtgctctcaacccttttaccctcaaaacgccccagtccaaccactcctacatccaaaatgagcgccggtttcgacccagcaaaactagccaagcttcaagctaacaatgcaaagctcgccggtgcccctcgaaagaaggtcgtccgaaaacctggtgccgctcagggagatgaccgtaaactacaaacggcgctgaagaagctgaacgtccagccgatcaccggcgtggaggaggttaacatgttcaaggaggatgga

SEQ ID NO: 2788 - DNA, 202 bp, Glycine max
ctggaacgaagatggcaccagcttcatcgtttggcgacccgcggaattcgctagggatttgcttcctaagtacttcaaacacaacaactatttcagtttcgtccgtcagcttaacacctatggtttccggaaggttgtccctgaccgttgggaattcgccaacgactgtttccggcgaggcgagagagctacttccacacaa

SEQ ID NO: 2789 - DNA, 256 bp, Glycine max
gttacttcagatttctaagacatgacccttattctgactatgcatcattttgtactagacttaagagccaaattaccaaaaacccagatcataggtatagaaagttacaagctgttttgaagacaataatgttacgccggaccaaaggtacacttcttgacggggaacctattatctccttgccgcctaagtatatagagctgaaaaaagttgatttttctatggaggaacgtgatttctattccaaactagaggc

SEQ ID NO: 2790 - DNA, 228 bp, Glycine max
ggttgatccagataagtgggagtttgctaatgagatgtttcttagagggcaaaggattcttctgaagaacattagaaggaggaaagcaaatcatcatcaatcccatcagcacgcgatgcagcaaggtgtagaagagccttttgttgaggtggggcagtttgaattagatggagaaattgatcggttaaggcgagacaggcaagttcttatggtggagttggtgaagct

SEQ ID NO: 2791 - DNA, 249 bp, Glycine max
gggtgaaaagggattgaaggattgttgttcttttctattggggttatatctgtgctttatgggaagccctatctgtcttcttgttgttttatttcgattcgatgtggcacattctacctttcatttctgtggcgtctcattgattggtattatgaatctcgaatttgcagggttttagaaaggttgacccagatcgatgggaatttgcaaatgaaggatttttaagaggtgaaaaacaacgtttaaaaa

SEQ ID NO: 2792 - DNA, 239 bp, Glycine max
cactgattgtgttcaatgctaaagggaagctttttgagtattcttctgaatccagcatggaaaacgtcctggaacgatatgagagacatactcatatagggaaacttgttggagatggtgatgaatcacagggaaactggtccttacaatgcttcaagctcaccggcaaagttgaagtcttagagaggaacttgaggaaatcagtgggagaagatctggatcccttaaacttgagagag

SEQ ID NO: 2793 - DNA, 252 bp, Glycine max
gtggctctcatcgtcttctccaccaaaggcaagctttcggactactccaaccaaccttgtacgtaaagaattcttgaacggtatgagaggtattcgtatgcggagaggcaacttgttggagatgatcaaccacaaatgaaaactgggttatagaacatgaaaagctcaaggctagggtggaggtactacagagaaatcaaaggaattttatgggagaagatctggacagcttaaatcttagaggacttcaga

SEQ ID NO: 2794 - DNA, 257 bp, Glycine max
aaaagcagcattcgtctggatggactattcaacattatctcatatgatttggtgccaaagctacagaatatgcttatgacacatgactttaaggttgtgattgctgatgagtcgcattttctgaaaatgccaggcaaagaggacaactgcttctcttcctgtcataaagaaagctcaatatgcattattgcttagtggaacacctgctttatcacgaccaattgaattattcaagcaggtaactttctttttctgtc

SEQ ID NO: 2795 - DNA, 251 bp, Glycine max
gtgatgaaattgcttctcaatataaggctggtggatatatacctcagctgagatggagctggagatgctgattctcaaatttttgaaattgaagtatatggagggggaatctccattgatgcatcgtactcgagttctaatggaaaaatgccagcacattcagacaggccagcttctcagattcctcaatttgatggaccaattccttacgatgatgatgtggtttctactccaaatatgtacaattatgg

SEQ ID NO: 2796 - DNA, 244 bp, Glycine max
ctgaggaagatcagggaaaagctgtaggttgagatggttcaatcaattggacccaagaataaacagaagtcctttcacggaggaagaagaagagcgtcttctagcttctcaccggattcatggcaatagatgggcagtaattgcaagacacttcccaggacgaactgataacgctgtcaagaatcattggcatgtgatgatggcaaggattcggagagaaaggtctaaaaattatagtccaaaa

SEQ ID NO: 2797 - DNA, 246 bp, Glycine max
ctaaagctctttgttgggacccgaatttgttgaattttcggaacccccatctttcccaaattttgagttggctgcaatagctacagacattagtaaccttgcttggcttaaaagtggattggagagtagtagtgccaaaatgatgggcaacacctctggaagggtagtatctaatggatctcaagtacatattggccattaaaatgccaaatagatcatcattcctattctgagtgaggactggat

SEQ ID NO: 2798 - DNA, 243 bp, Glycine max
gttttctgttttggaccatggacttggtttttaccaaatcaagaaaaggatgagcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggt

SEQ ID NO: 2799 - DNA, 257 bp, Glycine max
agaagattgaagaggacatgtctgatagaatagctagagaaaaagcggaagaagaggcaaggcagcaggcattgcttagaaagcgatcaaaagtccttcaacgggaacttcctaggcctcctacagcatcattggagcttataagaaattccttgatgagaactgacgtggacaagagttcctttgttccaccaacctctattgcccaagctgacgagatgattagacgggagcttctaagtttactggagcatgac

SEQ ID NO: 2800 - DNA, 236 bp, Glycine max
cagcatttgatcaaggcaatacaaggccacttagggaacaagaatataaaagaaggaaaaagaagaagacgacatagcaaagcctagaaacatgggtcaccattcttgctgcaaccaacagaaggttaaaagaggactttggtctcctgaggaagatgaaaagctcatcagatacattactactcatggatatggctgttggagtgaagttccagaaaaagctgggcttcaaaggt

SEQ ID NO: 2801 - DNA, 239 bp, Glycine max
gaaaaggagatgctttctgaagcacgagcccggttggccaacacaaaaggaaagaaagcaaaaaggaaagctagggagaaacagcttgaggaagccaggaggcttgcttctttacaaaagaagagagaattgaaggctgctggaattgatattaggcagcggaagagaaaaaggaaaggaatagattacaatgcagcaaccaaatgggagtgttcctgttatttagtaaccttggtgga

SEQ ID NO: 2802 - DNA, 244 bp, Glycine max
tggcacctgttggcaaacataaggagaaggaaacaaccttcttctcagccttcttcttcttcttcttcatcctcttattattattattcttcttcttctcaacaagcacaacaaggtcactgtgttgaagttggtcgctttggacttgatgaagagattgatcgtttgaggcgtgacaagcacgtgttgatgatggagcttgtgaagctgagacagcagcaacagaacacaaggtcataccttc

SEQ ID NO: 2803 - DNA, 238 bp, Glycine max
ccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggctatgacaactctggatttcgaagataccgtggaacctctgaagatttacctccagcgcttccgcgagatggagggagagaaaacgtggccgc

SEQ ID NO: 2804 - DNA, 245 bp, Glycine max
agaaaacagaagaagagaaaggacccaaatgcacccaagagggcaatgtctggtttcatgttcttttctaaattggaaagagagaatctaaagaaaactaatcctggaatttcatttacggatgtgtcaagagtacttggagagaaatggaaaaagttgtcagtggaagagaaggaaccatacgaggcaaaggcacgtgaagataaaaaacgttacaaggatgagattagtggtacaagaatccg

SEQ ID NO: 2805 - DNA, 251 bp, Glycine max
tggctcgagcttggactccagaggaagatatgaagttaattgcttatgtcactaggtatggctgctggaattggcgccaactccccaagtttgcaggtcttgcacgatgtgggaaaagttgtagattgagatggatgaattatctaaggcctaatatcaaaagagggaacttcactcaacaggaagaagaatgcatcatcagaatgcccaaaaaacttggtaacagatggtctgctattgcggttgagtta

SEQ ID NO: 2806 - DNA, 272 bp, Glycine max
gaaagatattccaacaccatggtaagagctccttactttgataaaaatggaataaaaaaaggtgcatggagcgaggaagaggataagaggctcatggcttatgttgagagacatgggcatcccaattggcgtcaactaccaaagtttgcaggattgcaaagatgtggaaagagttgcagacttcgttggatgaattaccttaggccaaatctaaaacgagggaactatacccagaaagaagagcaaataatcaaggatttgcataaaaagca

SEQ ID NO: 2807 - DNA, 254 bp, Glycine max
aagtgacgttctcaaagagaaggtctggtttgctgaagaaagcgcgcgagatctctgtgctgtgcgatgctgatgtggctctcatcgtcttctccaccaaaggcaagcttttggactactccaaccaaccttgtacggaaagaattcttgaacggtatgagaggtattcgtatgcggagaggcaacttgttggagatgatcaaccaccaaatgaaaactgggttatagaacatgaaaagctcaaggctagggtg

SEQ ID NO: 2808 - DNA, 273 bp, Glycine max
ttcccctcttaccaagcgctcggtggacacaaggccagtcaccggaaactcgccgccgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtgggg

SEQ ID NO: 2809 - DNA, 258 bp, Glycine max
tccacacgctttctccagagaccttcttcctagatacttcaagcacaacaatttctcaagcttcgtcaggcaactaaacacttacgttgcagctgttgcttggacaagaatctatggtagtgatagcaatcgttatttactcaagattattcagaagccgtagaatggatacgaattcgaagtagctggtctccaagaatcataactgattgttgcttttgaaccaagatccggttggtggttaacctgtcggtttga

SEQ ID NO: 2810 - DNA, 266 bp, Glycine max
gaagatgggaaggggtaaggtacagctgaagaggatagagaacaagatcaatcgccaggtaactttctccaaaaggagaagtgggttgctcaagaaagctcatgagatctctgtactctgtgatgctgaggtagctttgattgtcttctctcacaaaggaaagctctttgagtatgctactgattcatgcatggagaagatactggaacgccacgaaaggtatgcctatgcagagaggcagctagtagcaaatgattctgaaacac

SEQ ID NO: 2811 - DNA, 261 bp, Glycine max
ctcacagatggaaccggaagaaaccgccgccgccgccgacggaagcttcgacgaggggctgctcgggctagacgacggcggcggcggcggcagggacagagtaaagggtccgtggtcgccggaggaggacgccattctaagccgtctggtgggcaagttcggcgcgagaaattggagcctcattgcgcgcggaatcagcggaagatccggcaagtcatgccggctccggtggtgcaacagcttgaccccgccgtcaagcgc

SEQ ID NO: 2812 - DNA, 255 bp, Glycine max
catagccgcgcacctgcccaagagaactgacaacgacatcaagaactactggaacaccaacatcaagaaaggactcatcggaaagggcttagatccccttacctacaaaccaataaaatccaacacttttcaagcctatggtggtaatttccttgacccttccattgacaccaccaatatgaaccatgtggctcaatcggagagtgctcaaatcgaagccgaagcaagagaatctatgttgcaatttggatctct

SEQ ID NO: 2813 - DNA, 249 bp, Glycine max
caaatattttttcacttgctctccatcttttttcagttcatcagtggccaggtaggccatgggaagggctccatgttgtgacaaatccaatgtgaaaagagggccttggtctcctgatgaagatgccaccctcaaaaactacgttgagaaacatggcacaggtggtaactggatagctctccccaaaaaagcaggccttaagcgttgtgggaagagctgtcgtctaagatggctaaactatctcaggcc

SEQ ID NO: 2814 - DNA, 248 bp, Glycine max
ccttgtttggggtttgcatttttcctggttgaaaaagggaagaacttgaactaattggttaagttacctatctatctatctatctagggtataatattttatatcagttattaaaggaaagaaagaaagaaacgaagatgggaaggggtaaggtacagctgaagaggatagagaacaagatcaatcgccaggtaactttctccaaaaggagaagtgggttgctcaagaaagctcatgagatctctgta

SEQ ID NO: 2815 - DNA, 246 bp, Glycine max
tctcttctgaaatgtttagaggcttccttggccctctgtagcatttgtaatcatcctcctgaagatgcagttgtttcagtttgtggacatgttttctgtaaccaatgcatctgtgaacatcttaccggcgatgacaatcagtgccctgctgcaaattgcaaaagtcgactgagcacatctatggtattttcaaaaaccacactgaacagttgtctttctgaccagagttgtgatattcacccagtc

SEQ ID NO: 2816 - DNA, 252 bp, Glycine max
atttgggggaggtgagtgattctgtttgggaggacttgctgaaccaagacttggttgctggggaccctgaagaggaagttgtgattggtgatttttcacaagttgatgttcctgtggaggatttgattgcggatgctgatgagtggagtgaggatttgcagaaccttgtggatcacatgggttatcttgggtccaaaccgtagtgggaaggaaggattttcattatctagggggttcagataaaactttccc

SEQ ID NO: 2817 - DNA, 134 bp, Glycine max
gaaagaacacaccaacaaaggagcttggaccaaagaagaagacgaacgcctcatcaactacatcaagctccatggtgaaggctgttggagatccctccccaaagctgctggcttgctcagatgtggcagagttg

SEQ ID NO: 2818 - DNA, 189 bp, Glycine max
ctcaacacttacggattcaggaaagttgtgcctgatcggtgggagttctcgaacgattatttccgccgaggcgagaagcggcttctttgcgaaattcagcggcggaagatctcatcgccggcgccgtctccgactgcgccgacgacggttacggtgccgatgccgttgaccgcgataccgatcatatcg

SEQ ID NO: 2819 - DNA, 272 bp, Glycine max
gtgaaacgtggaacatgagccaccatcaagtccatgctcttcctcctcaactagcagcaacttttacagcaacaaacgttattgatactacgaattatctgccaccattgatagagaacgttgaaaacatggtgccaaatatggaagtacagtcttgtagtatagacgaggaaggagaaatggcactagagtgtttgcggagacaagatttgaatgagtgggtggagaatcaacaacaatgtcccagctttcttttctgggacaatattaat

SEQ ID NO: 2820 - DNA, 243 bp, Glycine max
  unsure (1)..(243): unsure at all n locations
gtggtaccgttgggagcccagtgtctgctaacaaaccaaacgtgagagataatcaagtaaaaggggtcgccaccactacaagtggttcctcacgtgagccatctgatgaggatgatgaagcaggtccttgtgaacaaagcacaaacgctattgatatgaagcgccttagaaggaaggtttctaatagagagtctgcaaggaggtccaggagaaganaacaagcccatttggctgacctggagt

SEQ ID NO: 2821 - DNA, 250 bp, Glycine max
ctcgagccgaatcggctcgagatcctgaactatatgaagacatcggtatcaagcctcctaagggggtcattttatatggacgaacctggtactgggaagaccttgcttgcgaaggccgtggcaaactcaacatcagcaacattcttgcgcgttgttggtagtgaattgataacaaagtacttgggagatggcccaaaacttgtgagagaactttcagagttgccgatgatctttctccttctattgtatt

SEQ ID NO: 2822 - DNA, 278 bp, Glycine max
caggaaattaaagaagcagttgagcttcccctgacacatcctgaactgtatgaagacattggtatcaagcctcctaagggagttattttatatggggaaccaggaactgggaagacattgcttgcaaaggctgtggcaaactcaacatcagcaacctttttgcgtgttgttggtagtgaattaatacaaaaatacttgggagatggtccaaagcttgtaagggaacttttccgagttgctgatgatctttccccatctattgtcttcattgatgagat

SEQ ID NO: 2823 - DNA, 257 bp, Glycine max
tctcgagccgaatcggctcgaggtccttgctgtagtcatgaggaaattaggaaaggggcatacacggttcaagaagatcagagactcattgcttacattcagaaacatggcacaggaagctggcgtaccttgccacaaaaagcaggtcttcaaagatgtggcagagtttccaggctgagatggtttaactaccttagacctgacattaagagaggaaaattaagccaagaagaagagcagacaattataaaacttcc

SEQ ID NO: 2824 - DNA, 266 bp, Glycine max
gttttggatggatacattgcatgtggttcagaatctaatgaggtgtactgttatcacaaatcactgcctgtgccaattgctactcataaatttgagtcaattgatcacatttctggtcatctaaatagtggtgataataatggacagtttgtttctagtgtttgctggagaaagaaatctaacatgcttgttgctgccaactcagttggaattgtgaaactattgcagatggtctgacacaaaagagaaaatatttggttaacatt

SEQ ID NO: 2825 - DNA, 250 bp, Glycine max
caactactactactataggtacttactactttgcctagctcctctttctctctcttcccttttgcactgaacttcactctctcttctatatcaagggttgatcacataacctcaatatatttctaataataattgatatagtttgagttattgtttcgagacacacagaaagagagagagagagagaatgggtagagggagagttgagttgaagaggatagagaacaaaatcaaccgccaagtaactttc

SEQ ID NO: 2826 - DNA, 247 bp, Glycine max
cgaactcatcatttctaattgttctgatccatatatatcatactttctttgtaataacttaaagaaccccacaaaaacaccaaccatgtccacaattgcaaagagagatttgagttctaatgaagaagagagtgagctgagaagaggtccttggactcttgaagaagacagcttactcatacactatattgctcgtcatggtgaaggccgttggaatatgttagccaaaagtgcaggattgaagagg

SEQ ID NO: 2827 - DNA, 250 bp, Glycine max
aaaagaagaaagaaacaaagatataaggaaaaagggaaaatattttgaataaggaagatataaggcaatatataaaaatattagtatttgataataattaggtgtagaaatattatggggaggggaagagtggaactcaaaaggatagagaacaagataaacaggcaggtaacgtttgcaaagaggagaaatgggcttctcaagaaagcctatgagctttctgttctctgtgatgctgaggttgccctca

SEQ ID NO: 2828 - DNA, 146 bp, Glycine max
taaattttgtgagtgtggacatactctgagcgtgagacagagaaggggaagaaagagagagagtgatgggaaggggaagagtggagttgaagagaattggagaacaagatacaacagagcaagtgcacctattgcgaaaacgaaag

SEQ ID NO: 2829 - DNA, 269 bp, Glycine max
tgtgcatattgttgggatgtggaaactggtaaagtgaaaatggtattcaaggggcacatggactatttgcattgtatagttgctcgcaactcatcaaatcagatcataacaggttcggaggatgggacaacacgaatttgggattgcaaaagtggaaagtgtacgcaagtgattgatccagcaagagatttgacattaaagggatctgcttcatgggttggttgtgttgctttagatgcaagtgagagctggttggcttgcagtagtgg

SEQ ID NO: 2830 - DNA, 149 bp, Glycine max
cgaatatcgcattcgcgaaatcatgcaggagtcggtaaaatgcatgcgccattcaaagagaacttgtcttactacagaggatgtggatactgcacttgcattgagaaatttggagccaatatatgggttcacatctaatgatcctccac

SEQ ID NO: 2831 - DNA, 235 bp, Glycine max
ctcccctcttccccacccaaccttctctctatcacacacacaagtcaatggataaaaaacaacagtgtaagacgtctcaagatcctgaagtgagaaaagggccttggacaatggaagaagacttgatcttgatgaactatattgcaaatcatggggaaggtgtttggaactctttggccaaagctgctggtctcaaacgtaacggaaagagttgccggctaaggtggctaaatta

SEQ ID NO: 2832 - DNA, 260 bp, Glycine max
ggctgctttaagctagggtttcatgtgtttaagtgattggttgatataaatactagtgtagtgtgtctttgtgtaaagggagaaaaacaaaagaaggtaaagcttgatgatatgaagctttcaacatcagggttggggcagcagggacatgaaggaggggagaagaagtgtctgaattctgagctatggcatgcatgtgcggggcccctggtgtccctaccaactgcagggactcgtgtggtttacttccctcagggtca

SEQ ID NO: 2833 - DNA, 261 bp, Glycine max
atgagattaagaactactggaggacaaggatccagaagcacctcaagcaagcttccagcagcttccagcaacagagtagtaattctgagataatttatcatccccaagcttgcactagccaagtgtccaccatggcgcacccatagaaacctattctccacccagttatcaaggaatgttagatccattttcaattcagttcccaacaaatcctcatcattctagttgttgtaccaatgacgacgacaacaacaactattg

SEQ ID NO: 2834 - DNA, 258 bp, Glycine max
atcagatacgaaggcattctctacaacatcaacaccgaagagtccagtattggcctcagaaatgtgcgatcttttggaacagaaggaagaaaaaaggatggcccacaaattcctccaggtgacaaggtttatgagtatatacttttccgtgggactgacatcaaggatttacaggttaaatcttctccacccgtccagcctattccacacgtcatcagaaaccaagctattattcagtctcactatcctcacccggtc

SEQ ID NO: 2835 - DNA, 281 bp, Glycine max
ggaagacttaggcccactgaatatcaaagaacttgagcatcttgaacggcaattggattcatctctaaagcaagtgaggtccacaaaggtaataatggataatttatacataaaaaatgtgttaagtttttggcaaattaatatatacttaagcttattaatgtagttcttgatcagtagttgcagcagcctagcgtaatttctctatttgatttaagcatctttccgtttttccgtacaatttgtttttgccaatactatggccgatgcaacattagaat

SEQ ID NO: 2836 - DNA, 260 bp, Glycine max
agaagggttgcttctggacgtgatgcagatgctgagggaggtgaggatagaagttataggggtgcagtcgtcgcttaacaatggggtgttcgtggcggagttgagggctaaggtgaaggaacatgcaaacggcaagaaggtcagcattgtggaagtgaagagggcacttaaccaaattataccccatgctgttgactaaagagggggtgcatgcttgaattttcagggcttgactttatggatgaatattccaagtagaa

SEQ ID NO: 2837 - DNA, 213 bp, Glycine max
ctagaacataacaagagttcaattctctccttcctctacctattcatgtcacaacaacaacaacaacaacaaatccttctctctgagaaagaaccagtgagtctctgaaaaccctagagtgtgagtgcgagagagaaatgtctgaaaccttctgcagcgactgcaagaggcagacggaggtggtgttcgaccactctgcgggggacacggtgt

SEQ ID NO: 2838 - DNA, 269 bp, Glycine max
gggacaacaaaagcaaaacaagtgcagcacatgtaatgtttcttttgatgacactaagctgtacagggaacatcacaagagtgaatggcacaagcacaatatcaagcgtaagacaaggcaactcccaccacttactgaggaagagtgcatggctgacatggaattgggtgattcaaaatctgatttgaaggattattcattttaagatgatgataagtgtgttggtgtaatcacattattgtagtcttgtgtgtatacttggtcaattt

SEQ ID NO: 2839 - DNA, 263 bp, Glycine max
  unsure (1)..(263): unsure at all n locations
agttctttatctatgttgcttcttatttgctttgtatgtgtgtggtttaattaggccttaagagatgtgggaaaagctgtcgtcttagatggctgaattatcttcgcccaaacatcaaacatgggggtttctcagaagaagaagacaacatcatctgcagcctctatgtncagtattggaagcaggtggtcaattatagcagcacagttaccagggcgcacagacaatgatatnnagaatattgggaacactaagcnggagaa

SEQ ID NO: 2840 - DNA, 260 bp, Glycine max
  unsure (1)..(260): unsure at all n locations
gatgcattaaaagaggaaattcagcatttganaatattgactgggcaagctatgccacctaatggaggacctatgatgaactttgcttcttttggagggggcagcaattctatcccaataatcatgccatgcacacccttttagctgcacaacagtttcaacagcttcaaattcaccctcaaaagncgcagcagcancagtttcagcagcttcagcaacagcagcgggancagcaccaacaatcaattgacttgaaaatg

SEQ ID NO: 2841 - DNA, 240 bp, Glycine max
  unsure (1)..(240): unsure at all n locations
gcaaaacttgtccgcgatgcctttcagctggcaaaagagaagtctccatgcattatatttatggatgnnattgatgcaattggaacaaagcgtttcgatagtgaagtangtggngacngggagttacagcgaacaatgttagaattgctcaatcagcttgatggttttagtagtgatgatcgtgttaaggtgattgcagcaacaaaccgtgctgatattcttgatcctgcccttatgtgt

SEQ ID NO: 2842 - DNA, 275 bp, Glycine max
  unsure (1)..(275): unsure at all n locations
aaaagtagtctctgaagccgatccagtgtcttgtgaatttggaattggtagtgaatttanatctaaaaagccatagcaatgtcttttatcggtacccagcaaaagtgcaaggcttgtgagaaaacggtttatccagttgatcagctttctgctgatggcactgcttatcacaaagcttgcttcagatgttctcactggcaaaggaacattaaagctgagcaactattcctcaatggaaggtgttctttattgtaagcctcactttgagcagctct

SEQ ID NO: 2843 - DNA, 259 bp, Glycine max
  unsure (1)..(259): unsure at all n locations
agctcgactacgaagacagcgacgctaacggcgaggcggagggttcggagannccggcgtcgttcgcgaagacgttaacccagtcagacgcgaacaacggcggcggattctccgttccgcgatactgcgcggagagatattcccgcggctggattactcggcggagcnccggtgcagacggtgatcgcgaggnacgtgcacggcgaggtgtggaagttccggcacatttaccgagggacgccacgtcggcacttgctga

SEQ ID NO: 2844 - DNA, 263 bp, Glycine max
  unsure (1)..(263): unsure at all n locations
gaaattctccacaggttgtttcttctggggctgnagaagtatggcaaaggtgattggaggaacatatccgcgcaattatgtgatcantccggacgccaactcaagttgctagccatgctccagaagtacttcataaggcaactatcaggaggcaaggacaagaggagggctagcatacatgacattacaacggttaatctcacagaaaccaccagaattcttctgatgaaagcaagagatccantcgccacaacattccatnt

SEQ ID NO: 2845 - DNA, 284 bp, Glycine max
ctttgcacttgggaaatgaaggagaggcaacgttggagagctgaagaggatgctttattacgttcttatgtcaaacagtatggtcctagggaatggaatcttgtgtctcagcgcatgaacacatatcttaacagggatgctaagtcgtgcttggagaggtggaagaactacctcaagcctggcatcaaaaaaggctctcttactaagaagagcagcgccttgtcatccaccttcaagcaaaatatggaaacaaatggaagaaaatcgctgctgaagtcccaggg

SEQ ID NO: 2846 - DNA, 286 bp, Glycine max
  unsure (1)..(286): unsure at all n locations
tttcaacggtgcaaaggnaactgncagnagtttgtanggtgctattccaanaacacaaagcaaggcacgtgctgtnaactctccnactaagagtnccataaccattgttgangaanaggctagcagtaacagttgcaagaccaagcnntttggggtgtctgnncaatcccaagaaaaanggtgcaccctnagtangggtctagcnatgttcttcagagnnccgaaaacgaataagncgcgttgggctttggnaaatgatggactantacgatgaatcttatgcccc

SEQ ID NO: 2847 - DNA, 289 bp, Glycine max
  unsure (1)..(289): unsure at all n locations
ggttccaagtttgaacttgaaagtgttgaactttctctagctttttcacaaatttggttgcacttgcaactgaggcaggaaaganggatcaccagggggcacgagaggaggacgaggaaaganacgccaaaacaagaaaagtagagaaagggtaggtgttgtacagaaatagaaattaaaaaattgagtgaaaaattaanagggaaatttttttagaagaagagtgatagggatatggggaggggnagagtggagttgaagaggatagagaacaagataaacaggcnag

SEQ ID NO: 2848 - DNA, 285 bp, Glycine max
  unsure (1)..(285): unsure at all n locations
gaagggcctaacagcaacattaacagctgcaagaccaaactttttggggtgtcgctgcagtccaagaaaagggtgcacccggattatggatctaatccagagaccaacaaggctcgtttggttttggaaaaggatgacttgggcttgaatctcatgcctccatccacttgttagttccactactgatgattaattctaagtatgatatgatatcccaagcnagctatatagctgcttaaattaattttcttttactacttgctttgatttgttttctatttaact

SEQ ID NO: 2849 - DNA, 258 bp, Glycine max
  unsure (1)..(258): unsure at all n locations
gggagcagatgttagtagaagcaaanagatccttgacagtgaagctggaagaaatcaattcaagaaaccactacaggcaatcatgggaagctggtgatcaaagtatgccatatggtggtggtggtccagagaattctcactctcattctcactctcagggcttcttccaaccattggaatgcaaccctanactacatattggtcctgattacaggtacaatgctgtagcttcagatcagataatgccacaactcaacc

SEQ ID NO: 2850 - DNA, 262 bp, Glycine max
  unsure (1)..(262): unsure at all n locations
aaacacttggctgtgcgaganctatagaagaaaaacggctcagcctcaacaaggaatcatgaaccaccatgcaccaccatgctcattctccgttgggagtcaacgttaacgttccaactttctttcccttctccagcagagtcagcatctctacttccaacgactccgacgaccaatccaactggtgcgactcgccgccacgtggagccacctcattggtgaacggtgcagcagcagccaactacaacacttccgtcacggc

SEQ ID NO: 2851 - DNA, 258 bp, Glycine max
  unsure (1)..(258): unsure at all n locations
ggactggaatgagtgatttgacatccctataaatggcncaagtcaaaatggaggtgcnngatggtcagatgggatgaggatattgagattagtcatcaagatagagtatctccatgggagattgatccttcttcgtctcttcctcccttgagcattcaatcctccagaaggctgaagaaactgaggccaggtctgcaggctgccacacccagtcacctcaccactggaggcagtgggtttatggactctgaggagtca

SEQ ID NO: 2852 - DNA, 253 bp, Glycine max
  unsure (1)..(253): unsure at all n locations
cactattgttttngcaagtcctcaaccccaacaacatagagagccataatacccttcttaggcacaacaatatggctttgtaaaatgggaaggagtccttgctgtagtcatgaggaattgaggaaaggggcatggacggttcaagaagatctcaaactcattgcttacattcagaaacatggcacaggaagctggcgtaccttgccacaaaaagcaggtttcaaagatgtggcaaganttgcaggctgagatg

SEQ ID NO: 2853 - DNA, 272 bp, Glycine max
  unsure (1)..(272): unsure at all n locations
tgatgcagtttgaaactgattatgttgttgaaagtgaattggcaataaatgaagatctttataacacaaagtacaaggacaagttggatctgtcttataaggggcttattcatgncgtgttcaccacaatattacgtggccttgtctggtgccaaagtgaccaagcccggaaaatttaggagttgtcaagatggctatgcagtgaaatcatctttgaaagctgaagatggaattctgtatccccttgagaagagcttcttctttctacctaa

SEQ ID NO: 2854 - DNA, 294 bp, Glycine max
  unsure (1)..(294): unsure at all n locations
cgaaaacctaaaagcatgggnncagggaacaccgggnggtctgaaccggcaggntcttccgggggaccggaagccggacggcggcgacaagaaggagaanaagttcgagccggcggcgcngncngcncgcgtnagccgtaagcagcgtanccagaagggcccgnaggcgactnnncngctgacnacngtgacgcggtntccnagtgcnanctaangctacttnaaactngattcgcattaaaagaattactnttgatngacgaggattctggcnaaccagatangttaanncgc

SEQ ID NO: 2855 - DNA, 277 bp, Glycine max
  unsure (1)..(277): unsure at all n locations
tcttttataattttattcganttcaaatataataccaaaaccgntccttgtttggccattggctctctacgtactagcggtttgaaacattacanactcaaagagtaagtnnnnnnnnnnnnnnnnnnnnnnnnnnnnnnnnnnnnnnnnngaaattggagatagacatggggcatcactcttgctgcaacaagcagaaggtcaaaagagggttatggtcacctgangangatgaaaagctcatcanctatctcagcaacttntggncatggttgct

SEQ ID NO: 2856 - DNA, 260 bp, Glycine max
  unsure (1)..(260): unsure at all n locations
ctttcatgcagggctgttaaggtgtggcaaaagttgcaggcncaggtggacaaattatctgaggccagacttgaagagaggccttctatcagaatatgaagagaaaatggtcattgatctccatgctcaacttggcaatagatggtctaagnttgcttctcatctcccaggaagaactgataatgagatcaagaatcactggacacccacataaagaaaaagctcaagaaaatgggaattgatcctgttactcacaagcc

SEQ ID NO: 2857 - DNA, 246 bp, Glycine max
  unsure (1)..(246): unsure at all n locations
cngcagccttagagccaaaagaaggtggtgcttatctggaantcctattcaaaatactattgatgatttgtatagctactttaggttcctaaagtatgatccttatgctgtatacaaatcattctacaatacaataaaagttccaatatccaaaagtactattcaaggttacaaganacttcaagcagttttaagggccataatgctacgtcgtncaaaaggaactttgcttncangggaagccaa

SEQ ID NO: 2858 - DNA, 259 bp, Glycine max
ttctcattctcccttaggagtcaacgttagcgtcccaactttctttcccttctccagcagagtcagcatctctccctccaacgactccgacgaccaagccaattggtgcgactcgccgccacgtggatccacctcattggtgaacggtgcagcagcagcagccaactacaacacttccgtcacggcgctttcggaggacaacgagagactcagaagaagcaacaacatgctcatgtcagaactcgcacacatgaagaag

SEQ ID NO: 2859 - DNA, 237 bp, Glycine max
  unsure (1)..(237): unsure at all n locations
acacataacacnctcncnanagcttganactttttactaagcagaggaccatggtgtcaaaaaatccgaacccctctgaggctttaaacttggacccctccggcatgtcgctccccggaatcctnnnnnnnnnnnnnnnnnnnnnnnnnnnnntttcctttgaggatcctgctaagaagactcgcaagccttacactatcaccaagtctagggagagttggaccgaacctgagcacg

SEQ ID NO: 2860 - DNA, 275 bp, Glycine max
  unsure (1)..(275): unsure at all n locations
agatgaagttgatccaatggtctctgttatgaaggttgaaaaggcacctttggaatcatatgctgatattggtggtttagatgctcagatacaggaaattaaagaagcagtcgaacttcccctgangcatcctgaactgtatgaagattggtannaagcccccntnngggantctttnanngggcaacccngnatggggaagactgnnnnnagaaggggtggcncncnccaancaccnacctttnggggggggggncnaanagnacnnaancgnc

SEQ ID NO: 2861 - DNA, 252 bp, Glycine max
  unsure (1)..(252): unsure at all n locations
agtgctcttatatggacctccangaactggaaaaacactaattgcccgtgcttgtgcagcacaaacaaatgccacttttctgaagttggcaggtccacagctggtccanatgtttataggagacggagcaaaacttgtccaggatgcctttcagctggcaaaagagaagtctccatgcattatatttatagatganattgatgcaattggaacaaagcgtttcgatagtgaagtaagtggagacagggaggt

SEQ ID NO: 2862 - DNA, 269 bp, Glycine max
ctaactggcaactaattaacgtgtttgggactcgcgagttgtgcattcctaacacccatttcaggaagcccaagcattgggagatgactagaaagaggatacagatcaagaaaatcgacaacatcagttcgaggcaagtgactttctccaagagaaggaaagggcttttcaagaaggctcaggagttgtcaaccctttgtgatgcagacatagctctcatagtcttttctgcaactagcaagctctttgagtatgccagttcaagcatg

SEQ ID NO: 2863 - DNA, 277 bp, Glycine max
  unsure (1)..(277): unsure at all n locations
cnaagaattagttgaagcaattgttttgccaatgacctgcaaggngcggttccaaaaattaggagttcgtccaccgaagggagtgctcttatatggacctccaggaactggaaaaacactaattgcccgtgcttgtgcagcacaaacaaatgccacttttctgaagttggcaggtccacagctggtccagatgtttatnggagacggngcaaaattgtccaggatgccttccgctggcaaaagagaagtctccancattatatttatagatganatt

SEQ ID NO: 2864 - DNA, 257 bp, Glycine max
  unsure (1)..(257): unsure at all n locations
caccgaatatattactatgatcttcgcaaccttaaaatgccactttgtactnnagttggacataacaagactgtgagctacatcaagtttgtagacactgtgaaccttgtctctgcttccacagataacacttgncagctttgggatttgtctacatgtgcatctcgagttatagactcaccgattcaatcattcactggtcacgcgaatgttaagaactttgtggggttatcagtatctgatggttacattgccac

SEQ ID NO: 2865 - DNA, 257 bp, Glycine max
gttgcaggctcaggtggacaaattacttgaggccagacttaaagagaggtcttttatcagaatacgaagaaaaaatggtcattgatcttcatgctcaacttggcaatagatggtctaagattgcttctcatctccctggaagaactgataatgagataaaaaatcattggaacacacacataaagaaaaagctcaagaaaatgggcattgatcctgccacacataaaccacttcctaatgcaaatgaacaaaaccat

SEQ ID NO: 2866 - DNA, 251 bp, Glycine max
atggctcaagaacctgtgtatgtgaatgccaaacagtaccaaggaattctgaggcgaagacaggctcgtgctaaagcagagcttgaaaggaagctcataaaatctagaaagccatatcttcatgaatctaggcatcagcatgctatgagaagggcaaggggtactggaggacgatttgcaaagaaaactgacggtgagggctcaaaccactcaggcaaggaaaaggataatggtactgattctgtcctatc

SEQ ID NO: 2867 - DNA, 263 bp, Glycine max
ggactcttctcagcttttggacctcaaatttcgggacggataatgcttccaattaacttgacatccgatgacggaccaacttacgtaaatgcgaagagtaccatggaatcatcagacgtcggctatcacgtgcaaaagccgtacttgagaacaaaatgattaaacgtcgcaagccatatatgcatgaatcacgccatctacatgcattgcggcgaccaagacgatgtggtggtcgcttcttgaacacaaaaggctctactaat

SEQ ID NO: 2868 - DNA, 275 bp, Glycine max
  unsure (1)..(275): unsure at all n locations
ggaatgcgtatccgagttcatcagtttcatcaccanccgaggcctctgataagtgtcagagggaaaagagaaagactattaacggtgatgatttgctctgggccatggccactcttggttttgaggattatatcgatcctcttaaaatttacctcactagntacagagagatggagggtgatncgaagggtttagccaagggcggagactcatcttctaagaaagatgttcagccaagtcctaatgctcaggtagaatgcacccacgaatgtgcg

SEQ ID NO: 2869 - DNA, 274 bp, Glycine max
  unsure (1)..(274): unsure at all n locations
caagcggaacaagtagtgctcctgatctttccctgaggaagctttatattggaagcttatcaccagaagtcacaagtgaaattctccttaactattttgcnaggcatggtgaaatagaggaaggttcagttgcatatgacagggntacnaatgaatcacgtggntttgggnttcncncntacaaggacngcggagttgaaagaagggcataggttncgtagaaaagatgctcgggggagggatatanntgntaaatatggnggttnccaccaag

SEQ ID NO: 2870 - DNA, 263 bp, Glycine max
  unsure (1)..(263): unsure at all n locations
accanctcccatttatattcccttctctcaccaattactttccaggttccattcccccnacacacaacacaacancnncaacatatccttattgttctcaaaccatgggtagatccccttgttgcgagaaagaacacaccaacaaaggagcttggaccaaagaagaagacgaacgcctcatcaactacatcaagctccatggtgaaggctgttggagatccctccccaaagctgctgggcttgctgagatgtggcaaaagttg

SEQ ID NO: 2871 - DNA, 254 bp, Glycine max
  unsure (1)..(254): unsure at all n locations
cacaacacgggttgcctcactttactctgccgcagatgtttatgttataaactctcaggggctgggagaaacatttggacgtgtgactatagaagcaatggcgtttggtcttccggttcttgggacggacgctggaggaacacaggagattgttgagcacaatgttacaggtctcttcatcctgttggacatccggggaatcttgttcttgcanagatcccnggtttttactcaaaaaccngtgggaaaggaac

SEQ ID NO: 2872 - DNA, 274 bp, Glycine max
cttcttttgctttcgcgttcgttttctctttctcggtcttgctttgctcagaattgctagttacgtgggagaattaagcaccaagaagatgggaaggggtagggttcagctgaagcggatcgagaacaaaacaagccagcaagtgacgtttttcaagcgtagatcgggacttctcaagaaagccagcgaaatctctgtgctatgtgatgctcaagttgcttgattatattttctaccaaaggcaaactttttgagtattcctctgaacgcagca

SEQ ID NO: 2873 - DNA, 268 bp, Glycine max
tctttctttacctattctctcccgtctcaaacattttctcctccatctctcgtcagattcaagatataactcattgagcaaagtagcttataaaatttgctcaacatttattagctcatcaaacagaactacttaattagctagctagcagtatgggaagagcaccttgttgtgacaagaatggtctcaagaaagggccatggacaaccgaggaggaccagaaactcattgatcacattcagaaaaatggatatggcaattggaggac

SEQ ID NO: 2874 - DNA, 269 bp, Glycine max
aaataacactctctctctctcagttatttctgccgtaaatagacaagggttatctcaaataatcaatctaagctagctgaaagcaacaacaacaacatggggagggcaccttgctgtgacaaatcaaacgtgaagaaaggccctcggtcgccagatgaagatgccaaactcaaatcctacatcgaacagcacggaaccggagggtactggcatgcaatcccacaaaagattggcctcaaacgatgtggcaagagttgccgtctcaggtg

SEQ ID NO: 2875 - DNA, 239 bp, Glycine max
ctttgttttgtttccgtgtttttctctctctgattttttgtgacccaaactaactttaaaagcattacgtgtttgaaattaatatcttgtgtgagcaaggttcttcatcatggcaaagtcttctagtgagaagaatggactgaagaagggtccatggactccagaggaagatcagaaactcatcgattacattcagaaacatggacatgggaaatggagaacccttcccaaaaatgcag

SEQ ID NO: 2876 - DNA, 273 bp, Glycine max
gcaggatctatctcagccaaagtcagaagttagtccaccagaaggattgctggcagttcctcttttaagacatcacagaattgctttatcatggatggttcaaaaggaaacatcaagtttatattgctcaggaggaattcttgcagatgatcagggacttggaaaaacagtatcaactattgcattaatattaaaggaaagacctccattacttaatgggtgcaccaatgcccgaaaaagtgaattggaaactctgaatctggatgtggatga

SEQ ID NO: 2877 - DNA, 301 bp, Glycine max
atcaaagtcggagagaaagggtactacgtacgtacctgcaggctgcagcaacctcgaagctagttcaaactagtgggaggttgtgtgcatagaagcacaaacaaacaaactcatcatcatactcacaattaatgcaaattaagcattgattaatggctcgcggaaaggttcagctgaagagaattgagaaccctgtgcacaggcaagttaccttctgcaagcgccgagctgggcttcttaagaaggctaaggagctatctgtgctgtgcgatgctgaaattggcctattcattttctctgc

SEQ ID NO: 2878 - DNA, 285 bp, Glycine max
gattggcttgccttcagccaagctagattttccagtttccaatgtgattggaacatcagactttggggaatcactaaggttccagaaggtcttgcaaggtcaagacatgttgggtgttaatactacttatgatagttttaatgctcacagtcaccagctatctgatttgaggaggtgctatcctggctcgaactatcctaggattgctgcaacaggaaatagcattggaatctcacaagtgagttccaatgtttccaacaacggcataggctttagtgaatcttt

SEQ ID NO: 2879 - DNA, 231 bp, Glycine max
ctcgagcgttgtgccatttcttctctcaataaacttctattgatgccccgctccacgttccattcttcagtatcctttgtagtttgaaccttcctcacactcccacttccgaaaccaatcaaagagagagagagagagagatgggtagagctccttgttgtgacaaggcaaatgtaaagaaaggaccatggtcaccagaagaagatgaaacgctaaaggattacatagagc

SEQ ID NO: 2880 - DNA, 260 bp, Glycine max
cacaaagcaagcgcgtgctgtgaactcttctcccactaacagttccataaccattgttgaagaagaggctagcagtaacagctgcaagaccaagctttttggtgtgtctctccaatccaagaaaagggtgcaccctgatgagtacggatctaactatattcttcaaagctccgaaacgaataataaggcgcgtttggttttggaaaatgatgctattaggcttgaatcttatgcccccttcaacttgttaattagttagt

SEQ ID NO: 2881 - DNA, 270 bp, Glycine max
ctctgacacaagaattaagttgtgagatggagagaagtagtgaagaggagatgttaataacgaaaggtccatggacagagcaagaggattctcttctcttcaattacatcactgtccacggcgaaggtcactggaactctgtcgctcgctacacaggcatgcaaagcattaattatattcatcatcttaatcctagcttctttcttactcacactcatcacgttttcaatcacaggtctaaaacgaacgggcaaaagctgcagattaaga

SEQ ID NO: 2882 - DNA, 271 bp, Glycine max
tcttcatgaagaataggagttgtcaagatggttatgcagtgaaatcatctttgaaagctgaagatggaattctgtatccccttgagaagagcttcttctttctacctaaacctcccactcttattcttcatgaagagattgactatgtggaattcgagcggcatgctgctggtggctccaatatgcattattttgaccttcttatcagactaaaatctgaacaagagcatctcttccgtaatattcagagaaatgagtaccacaatttgtt

SEQ ID NO: 2883 - DNA, 252 bp, Glycine max
gagaaattgagaagatgggaagaaaggccaactgtgacaatcaatatgctatgaacagaggtccttggtctgctgaagaagacaaaattcttatgaactacgttcaagtccatggagaaggaaaatggagagagctttccaaaagagcaggcttgaaaagatgtgggaagagttgtagactccgatggctgaattatctcaagccagatatcaagagaggaaacatttcttcggatgaagaagatctcatta

SEQ ID NO: 2884 - DNA, 267 bp, Glycine max
gaacctgtctcaatgatcttatgtactttcctacccgtaatgcatatggtctctctagtgttgctggaaacatggaaaaactagcagctttgcagaatgagtttgagaatgtgagaaacaaattggatgatggtaaggagaagatggtacggcttgagaagaaggtgatggttctcacgcaaggttatgagatgagagtaaagaaaagcctgtggccacaaattgaggccactttcaagcagatggatgtagctgcaactgagttag

SEQ ID NO: 2885 - DNA, 166 bp, Glycine max
gcagaatattaccatccatattaacaatttacaagttataatgtcattagagcattcagtttcagatgtaactgaactggttattacaaatcaaagtgccgtttttattcaaaaaaaaaaaaaaaaaaaaaaaaaaaaaaaaaaagagaagagagagggggagagg

SEQ ID NO: 2886 - DNA, 244 bp, Glycine max
taacaagttcaaattacaatgggtagatcaccttgttgtaacaaaaatggcctcaagaaaggaccatggacaccagaagaagatgatcttataatcagaatgcattcacttttgggaaacagatggtccctcatagcaggaaggttaccagggagaacagacaatgaaataaagaactactggaacacccatctaagcaaaaagctgaaattccagggacagaagacacagacacacccaaatg

SEQ ID NO: 2887 - DNA, 283 bp, Glycine max
tggattttcaagaggggcatctgtgtatagaggtgtgacaagacaccatcaacatggaaggtggcaggcccgaataggaagggttgcaggaaacaaggacttgtatcttggtacatttagcacacaagaagaagctgctgaagcatatgatatagcagcaatcaagttcagaggaacaagtgctgtgaccaactttgacataagtaggtatgatgtgaagagaatctgctcaagctccactcttattgcaggagatcttgcaaaacggtctcctaaagaatca

SEQ ID NO: 2888 - DNA, 263 bp, Glycine max
gatcaaacggatagcaccagccaaagtaatttacccctagtttacttttgcctcttataatgaatggatgcaacaatacatgggtgccatataggaagggatgaagaagaactcagagcttgtggctaatgttgaaaagcatgtccatggaaactggtgttcagttccagccaaaaagcagatgtagaaggaccggagctgcagactgaggtggattaacgacctcaaaccagagataaaatgaggaaactttagtttagcag

SEQ ID NO: 2889 - DNA, 283 bp, Glycine max
tcagaattcggctccagcacctggttacatacctggatgtatatatcttcaaagatgtagaaggaccggagctgcagactgaggtggattaacgacctcaaaccagagataaaatgaggaaactttagtttagcagaagatatatcataccattaaaatactccatgctcttggaaacaaatgatcaatcacaacatctcacagcttgtccaatacaacaaataatgagatcaagaattgttggaacaccaacatcaagaaaaagcttatgagaaagagaata

SEQ ID NO: 2890 - DNA, 267 bp, Glycine max
agacacaatgcaagaatgcgtttctgaattcatcagcttcattaccagcgaggcgagtgagaaatgccagaaggagaagagaaagacaatcaatggagacgatttactatgggccatggcaactttagggtttgaagatacattgagccgcttaaggtgtacctggctaggtacagagaggcggagggtgacactaaaggatctgctagaagtggtgatggatctgctagaccagatcaagttggccttgcaggtcaaaatgctcag

SEQ ID NO: 2891 - DNA, 199 bp, Glycine max
cggctcgaggcgagctcttcatcctcgagctcaccatccgctcctggctccacgccgacgagaacaagcgccgcaccctccagaagaacgacatcgccgccgccatcactcgcaccgacattttcgacttcctcgtcgacatcgtcccccgcgacgagatcaaggacgacgccgcgctcgtcggggcaacggcaatggg

SEQ ID NO: 2892 - DNA, 283 bp, Glycine max
tgctgctggtggctccaatatgcattattttgaccttcttatcagactaaaatctgaacaagagcatctcttccgtaatattcagagaaatgagtaccacaatttgtatgaatttatcagttcaaagggcttgaaaattatgaacttaggagatgcccaacctactgttggtataaagaaggttcttgagaatgatgatgatgatgctgttgatccacatcttgagcgcataaaaaatgaagctggtgaagatgaaagtgatgaggaggattctgattttgtt

SEQ ID NO: 2893 - DNA, 256 bp, Glycine max
gaatggttctatttgttgtgtgtctctttctcctttcatcttggtatcgggttgcccggaacagcatatgccaggaggcagcatttatggctcagtggtgcaaacgaagtagacagcaaaactttttcaagagctattcttgccaagagtgctcatatacagacagtggtgtgtattcctgtgttggagggcgtcgttgagttgggcacaaccgataagatcgaagaagacctaaatttcatccaacacataaaga

SEQ ID NO: 2894 - DNA, 267 bp, Glycine max
caggcagcaaacatgatgaagaagattggccttcttgaagctgcaaaacggaagttcttgggggaagggttgggggcttgctccattgaggaactgcaatggatagaacaacagttggagaggagtttaagtaatgttagaacaagaaagatccaggttttcaaggaacaaatcgagcaactaaaagaaaaggaaaaagtcctacttgatgaaaatgtcaagctcactgaaaatcgcaggctctctgagaagcatggaatcaatcta

SEQ ID NO: 2895 - DNA, 269 bp, Glycine max
caattatggtttccaatttattaattgtgtgttgagtttttgtttttggattttgggtactaaaacttatgtattggggtttaaatttcatagggttttagaaaaattgatccagataggtgggagtttgcaaatgaaggattccttagagggcacaggcacctgttggcaaacataaggagaaggaaacaaccttcttctcagccttcttcttcttcttcttcatcctcttattattattattcttcttcttctcaacaagcacaaca

SEQ ID NO: 2896 - DNA, 153 bp, Glycine max
gtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagag

SEQ ID NO: 2897 - DNA, 265 bp, Glycine max
aaagagctgcagattgagatggattaattatctgaggccagacctcaagagacgtggatttactgaaatggaagaggatcaaattatacagctacattcatgtctaggtaacaggtggtctaagattgcttcacattttcctgggaagacagacaatgaaatcaagaaccattggaacactaaaatcaagaagaggttgaagctcctaggtttggaccctttaaccctgaagccatctgagcaaaaggaaaagtctgttgatgac

SEQ ID NO: 2898 - DNA, 276 bp, Glycine max
  unsure (1)..(276): unsure at all n locations
ctgctaagcaagctgtcaaaacaactcctgagctgacaaggtctcatagtaaagctgctagcatgttttctgggacccaagaaaagtgtgctacatgtggcaaaactgcttatcctttggaggaggtaacagtggaagggcaggcctatcacaaatcttgtttcaaatgttcactggaaggtgtcgcatnactccatccaactatgcagtcctggagggcgttttgtattgcaagcaccatttttcccagctttttaagggagaagggagctataa

SEQ ID NO: 2899 - DNA, 273 bp, Glycine max
cttttaaataccatgtttcttctttctttaaaataatatttactaattgatcactaccaaaaacagctggtcttcttagatgcggaaaaagttgccgactgagatggatgaactatctgagacctgatataaagagaggaaacataaccccagaagaagatgatcttataattagaatgcactcacttttaggaaatatctggtccctcatcgcgggaagattaccaggacgaacagataatgagattaagaactactggaatacccatctca

SEQ ID NO: 2900 - DNA, 270 bp, Glycine max
  unsure (1)..(270): unsure at all n locations
gtacgttcgtcattcggctcgaggcttgtgttagtgaggttagaagataaagaaagaatggcatttgcaggaacaacccagaagtgtatggcctgcgacaaaacggtttatctggttgataagttgaccgcggataaccgagtgttccacaaagcttgcttcatccgncatcactgcaaaggaaccctcaaggtctctctccctcttttacaattcttgttgattatatagtctctatctagttcaggcttctagctttggatctggtgt

SEQ ID NO: 2901 - DNA, 275 bp, Glycine max
cggaatcggctcgagcggtcgagcgatgcaaaggcagacggagtgggttgaccatctgccggcgacacggtgtgcttggagtgcggcctcgtactggagtccactctatcgacgagacctctgagtggcgtaccttcgccaacgagtccggtgacaacgatcccaatcgtgtcggcgggccctccaaccccctcctcaccgacggcggcctctccaccgtcatcgccaagcccaacggcggcggaggtggcggcgagttcctctcctcctccctc

SEQ ID NO: 2902 - DNA, 273 bp, Glycine max
cggctcgagggaatcatatgctgatattcgtggtttagatgctcagatacaggaaattacagaagcagtcgaacttcccctgacgcatcctgaactgtatgaagacattggtatcaagcctcctaagggagtcattttatacggcgaacctggaactgggaagacgttgctagctaaggctgtggcaaactcgacatcagcaacctttttacgtgttgttggtagtgaattaatacaaaaatacttgggagatggtccaaaacttgtaaggga

SEQ ID NO: 2903 - DNA, 229 bp, Glycine max
cggctcgagattttatagtagtgcttctcaaaatttctagaacccacgtcacacgtactctgggaaggatagtcttggaaaatgcctggttccgtattatataagagtctcgccctagaatcctcgaggaggagaatttaatacactgtactttatccatttgtgtggggaattatggtaattgattttgagggtttgactactcatggattatgatggtatgagaaaa

SEQ ID NO: 2904 - DNA, 222 bp, Glycine max
cggacacaaacgttgtcactacgaaggtaacggtaacggaaataacaacaacagtaacagcgttgtcaccgtcgcctcggaaggcgtggggtccacccacactgtcagtcacggccaccaccgcgacttcgatctcaacatcccggcctttccggatttttcgaccacaggtcggagaagacgaggttgagagccctcaccctgtcatgaagaagctcgctc

SEQ ID NO: 2905 - DNA, 261 bp, Glycine max
cgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcaacatcccggcttttccggatttttcgaccaaggtcggagaagacgaggttgagag

SEQ ID NO: 2906 - DNA, 283 bp, Glycine max
gcataattcaagagctgcatgctaggtggggaaacaggtggtcaacaattggaagaagcttgccaggaagaactgacaatgagataaagaattattggaggactcacttcaagaaaaagatgaaaactccatctgatgctgctgagaaggcgagatccactcctcgaggagacagcattttcagcagcaacaacagcagttgaagcagcagcagcaacaattccaattcaacttggacatgaaagggatcataaacttgcttgaggaaaatgaccatagagtg

SEQ ID NO: 2907 - DNA, 267 bp, Glycine max
attgcaggatatcagtcaacctaaaacagaatatgacttacctgctggtgtactgtctgtctctcttctgagacatcagaaaattgcattggcttggatgcttcagaaggaaaccaagagtttgcattgcttgggggggattttggctgatgatcagggccttggaaagacaatttcgatgatttccctcatcctggcacagaggacattacagtcaaaatcgaaaatagatgatacatgcagtcataaaactgaagctttgaattt

SEQ ID NO: 2908 - DNA, 257 bp, Glycine max
cttaaccgctctcctcctttttagttgttccccttaatcttgttcctctcatatttttcttttttcttattagatcagattgaacaaaagggttgctctttattttttaatcttgggggaataatagaaatagaataagaaaagattagtgaggttgaaatgttgcaacaacgatcggtgccggcaccgttcttgacgaagacgtatcagttggtggaggatccggggacggacgaggtaatatcgtggggtgaaag

SEQ ID NO: 2909 - DNA, 262 bp, Glycine max
aaagactcagatgaggcgcatagagaacgccacaagcaggcaagtcaccttctcaaagcggcgtaatgggttgctgaagaaggcctttgaactttctgttctttgtgatgctgaggttgctctcatcattttctctccaagaggaaagctttatgaatttgcaagctccagcatgcaggacacaattgaacgctaccgcaggcataacaggagtgctcaaacagtgaacagatctgatgaacaaaatatgcagcatttgaag

SEQ ID NO: 2910 - DNA, 279 bp, Glycine max
tctttctctttctcactcactctcactctctgtcacggacagacagagaaaaactcagacacccacgtttccacttccctcacaccatcccttactgttccttcttcttcttcttccttttttttttcctcctaatggaatgatggaacacaacatcatcgttaacaacaacaacgtgatcgcaccgtttgtcataaaaacctacaacatggtgaacgttcccaccaccgataaactcatcatgtggggcccagccaacaacagcttcatcgtcctcga

SEQ ID NO: 2911 - DNA, 253 bp, Glycine max
atttggcttggaacgtatccagtgcctgagatggccgcacgtgcgcacgacgtcgccgcgctcgcgcttcggggcacgtcggcttgcctcaacttcgccgactcggcgtggcggctgcccttgccggcgtcgacaaatgcgaaggagatacggcgagtggcggcggcggctgctgtagcgattgcggcggaagacagctgcggcgagcagttacagaatagtattgtgaatgatgccgttgctgatgattgtg

SEQ ID NO: 2912 - DNA, 144 bp, Glycine max
cgttcactgtactttatccctttctgtgagggaattatggtaattgatatcgaggttttgactcatggattctgatcgccccagaaaaccttccaaaaatttagttcactctcgcttcttacttttcggcttctattgctgggc

SEQ ID NO: 2913 - DNA, 258 bp, Glycine max
gtggcacaatcatcttgatccaaccgtaaagaaggatgcatggacagaggaggaggaactaatacttgcttactattaccaaatatacggcagtaagtgggcagaaattgcaaggattcttcccggaaggtactttgtttgaatgttaatatgcaggcttcaaaacattcatcaatacgtatgtataaaatatgattttaatcatgttaatatgatttgattttggttataatttttcaaaaaaaaaaatctgtttat

SEQ ID NO: 2914 - DNA, 266 bp, Glycine max
gtttggaaggattattaaggtgtgggaagagttgcaggctgagatggattaactatttgagagctgaccttaaaagaggaaacatttctgctgaagaggaaaataccattgttaagttgcacgcttcttttggtaacaggtggtctttgatagcaaatcacttaccaggaagaacagacaacgagataaaaaactactggaattctcacctcagcaggaaaatttacagtttcccaggtgcaggtgcaggtgcaagtgcagggatc

SEQ ID NO: 2915 - DNA, 274 bp, Glycine max
ggaatcggctcgcgctgagccgaatcggctcgagttgcagcagaaagaactcaaagacagagatcatcatggtcaggggaaagactcagatcaagcgtatagagaacgccacaagcaggcaagtaactttctcaaagcggcgaaatgggttgctgaagaaggcctttgagctatcagttctgtgtgatgctgaggttgctcttatcatcttctcttcaagtgggaagctctatgaatttgctagctccagcatacagtgttcaattgaacgata

SEQ ID NO: 2916 - DNA, 278 bp, Glycine max
agaagatgattatccatcttcaagcacttttagggaacagatgggctgcaatagctgcttacctaccacaaagaacagataatgacataaaaaactattggaacacatatttgaaaaagaagctgaacaaaaaattggaagcaggttctgatcaaggaagcttgttgggaggaggacataataatattgggttttcatcagtttctcaaccaatgtctagaggccagtgggaaagaaggcttcaaacagatattcacatggccaaaaaagcacttagt

SEQ ID NO: 2917 - DNA, 242 bp, Glycine max
ctcgcttcttcctttttgggttctattgctgttattgggagttcttgaccgctctcctcctttttagttcttccccttaatcttctttcttcacaatttttatttccttccttattagacgtattagatcagattaacaaaagggtttttctttctttctttcttggggaataatagaaataagaaaagattagtgaggttgaaatgtcgcaacgatcggtgccggcgccgttcttgacgaa

SEQ ID NO: 2918 - DNA, 298 bp, Glycine max
ccgaagaagaccgctccgcccaggaaaccgtccacaatggcgtcgcctagacggagctaggcggcgaggagatggacatcgctgaggtgacggccgccggaagagtgaagggaccgtggtctccagaggaggacgcgctgctgagccgattggtggcgcagttcggtgcaaggaactggagcatgatcgcgcggggagtgccgggacgctccggcaagtcgtgccggctccggtggtgtaatcagctggacccatgcgtgaaacgcaagcacttcactgaggaagaggatagcatcat

SEQ ID NO: 2919 - DNA, 287 bp, Glycine max
gatactttgggcgaagaacatctcaatatagaggtgtaacaaggcataggtggactggtagatatgaagctcatctatgggacaacagctgcaagaaagagggcaaaggaaggaaaggaaggcaagtttatctagggggttatgatatggaagaaaaagcagcaagagcttatgatatgtccgcactcaagtattggggaccatcctctcatataaatttcccattggagaattatcaaaacgaacttgaggacatgaagaacatgacgagacaagaatatgttgct

SEQ ID NO: 2920 - DNA, 260 bp, Glycine max
ctgccttgtgctcacaattttcatgtcgaatgcattgatgagtggcttaggttgaatgtgaaatgtcctcggtgccgttgctcagttttcccagaccttgatcttagtgcactgtccaatctccgtgctgagcctgaacaatcttctgccagtgttgtgacaacaaccagatatgtgagaggccaaccatctagtcaaagttaccggctaagattgcagggtcttctgcgtccagtccgtgctgaaattgcaggaccagt

SEQ ID NO: 2921 - DNA, 267 bp, Glycine max
ggttcagcaagatatccgaagtggtccctggacagaacaggaggactacaaattggtgtattttgttggcatgttcggagatcgtagatggggactttatagcaaaggtatcaggtttgaaggtggagggagactgtaaataaaataggtttgaatagaacaggtaagagttgcagattacggtgggttaattacctccaccccgatctcaaacgagggaagctcacaccccaagaacaacacctcgtcatggaccttcattccaaa

SEQ ID NO: 2922 - DNA, 286 bp, Glycine max
  unsure (1)..(286): unsure at all n locations
cttggctctttgcctcatcatgcttgcacaaagcggtaacaacaacaacattcaattaccgtcttcgtcacagtcacacaaatcagcgtcttcgnngntgaaactatnacacaggtgcancgtttgnaacaaggcttttccttcttaccaagcactcggtggacacaaggccagccaccgcaaggcctcgtcggaatccaacaccaccgcctccgccgtcgccgtctctgccacagccaacgacagcttttnggcttcgaccgtcggctgcggaaggatgcacgag

SEQ ID NO: 2923 - DNA, 272 bp, Glycine max
agggtccatggtcgccggaagacgacgtcattctgagccgtctggtgagcaagttcggcgcgagaaattggagcctcatcgcgcgcgggaacagcggaagatacggcaagtcgtgccggctccggtggagcaaccagctcgatcccgcagtcaagcgcaaacccgtcaccgatgaggaggaccagatgacagttgctgctcatgcaatccatgggaacaaatgggcagccattgccaggcttctaccaggaagaacagataatgcgattaag

SEQ ID NO: 2924 - DNA, 270 bp, Glycine max
caaccacctctttcaattctctcctctcttattccaaactcaaattagaggaaaaagggtcaaataataattaagtgtaatatggatacgatcagtgttcaggcgatgagaagcttatcagatagtgactcattatcatctgcaacatatgcaagtgaagaagatatgaaaattaagaaaggtccatggactgaggaagaagattctgttctgatcaactacgtcaacttccaaggcgaaggttcatggaactccctcgctcgctctgca

SEQ ID NO: 2925 - DNA, 252 bp, Glycine max
attgaactgatggcgagcgccatgttaggggatgctaccacgagctttgaagatggtaagttggcgtctatgaccaccgatgacgtcgtcagagcctctcgtattctcgaaaacgatattcgcattctcaaggaagaggtgcagagatcgaatcgggaatgggaatcgtacaaggagaagatacaagataatgaggagaaagttaaacttaataagcaattgcccctactcgttggtaacattgttgagata

SEQ ID NO: 2926 - DNA, 254 bp, Glycine max
catcaccaacatggaagatgtcaagcgaggataggcagagttgctgggaacaaagacctttaccttgggacgttcagcacccaagaggaagcagcagaagcatacgatgtagcggcgatcaaatttcgcgggcaaatgcagtcacaaactttgacatttcaagatacgatgtggagagaatcatggccagtagcaatctcctcgctggggagcttgcaaggcgtaagaaagataacgatcctagaaacaaggac

SEQ ID NO: 2927 - DNA, 109 bp, Glycine max
ggcctttgtggtttcaggattgccgagctgttgatgttctcaatgtgctgcccacagcaaatggtggaacccattgagctgctgttatactgcagctagtgatgcacca

SEQ ID NO: 2928 - DNA, 267 bp, Glycine max
gcgagctttgcattgcttggcagatttgcgaacaaggagcgaagagattcgagcccactggttcttaccatatttcataacagccgctttcaggatttcatcttcggtgtttttccaaacaccgcccttaatcataatcctcatcttcgcttcaactacagacagcaacaaaacaattcaaacaaagatgattagatgtgaaaaataggggaaaagaaaaataaagagaaatcagggtttaggttagggaatcagagacgcaccaca

SEQ ID NO: 2929 - DNA, 276 bp, Glycine max
taaagttaatgaagatggccggttcggttagaactggaggaaagggtactgtgagaagtctcatatggacatatgaatattttagcttttctccccctccccgctcttccactatgcactcggttgtgggttttcactcaatttgttggctttttagtttttttggaattgaacacaaaatgcatctgttgtgttgaatgctctctttatgttttgtcttatgtttgttctagaaagaagaaggctgtccacaagacaacaaccacagatgacaaa

SEQ ID NO: 2930 - DNA, 93 bp, Glycine max
gggtttagcgaagggaccgtagaagccagaggaagatcagaagctcctggcttctactgaagatcatggccatggcagctcacgtgctttgcc

SEQ ID NO: 2931 - DNA, 263 bp, Glycine max
gcaaagttgggttatgctagtgaccttgcaggaagtcaggaacttgctgaaggtagtcgtgcaacacaggctcttctgactaattatgcacagacacctggccaaggaatgactcctttgcgaacccctcagagaacaccggctggtaaaggtgatgctatcatgatggaagctgaaaatctggccaggctgagggagtctcaaacaccattgttaggaggagagaacccagagttgcatccttcagatttttccggtgtcac

SEQ ID NO: 2932 - DNA, 285 bp, Glycine max
atagttatgatatggaagaaaaagctgcaagagcttatgatatggccgcactcaagtattggggaccctcctcccatataaatttccctttggaaaattatcaaaacgaacttgaggaaatgaagaacatgacgagacaagaatatgtagctcatttacgaaggaaaagcagcggattctcaagaggggcctccatgtacagaggagtaacaaggcaccaccaacacggaaggtggcaagctcgaattggaagagtggctggaaacaaagatctatatcttggaa

SEQ ID NO: 2933 - DNA, 272 bp, Glycine max
ctccacgagctcgagccgaatcggctcgaggcgacgatttgctttgggctatgaccactttacgactcgaaccgtatattgatccgctcaaggtttaactcgccgcttacagagagattgagggtgattcaaagggttcggccaagggtggagatgcatctgctaagagagatgtttatcagagtcctaatggccaggttgagaatgttgctcatcaaggttctttctcacaaggtgttaattatacgaattcttagccccaggctcaacat

SEQ ID NO: 2934 - DNA, 264 bp, Glycine max
tttcccttcgtgacaaactacgactaacacacacagaacatagcttctgttggtgaggtgagaagataaagaaagaatggcatttgcatgaacaacacagaagtgtatggcctgtgacaaaaccgtttatcttgttgataagttgaccgcggataaccgagttttccacaaagcttgcttcatcatgccatcagtggaaaggaaccctcaagctgagcaactacaactcttttgagggagttctttattgtacgccacatttga

SEQ ID NO: 2935 - DNA, 274 bp, Glycine max
ggatcagcaaagataattctggcaatgttattccagaatacttggtcaagtggcaaggactatcttatgctgaagcgacttgggaaaaggacattgatattgcttttgctcaacatactattgatgagtataaggctcgtgaggctgatatggcagttcaaggaaagatggtagattctcagcgtaagaagagcacagcaagtttgcggaagcttgaggaacaacctgaatggttgaagggtggaaagctccgtgattatcaacttgagggtct

SEQ ID NO: 2936 - DNA, 269 bp, Glycine max
aaggaaggcaagtttatatagggggttatgatatggaagaaaacgctgcaagagcttatgatatggccgcactcaagtattggagacaatcctcccatatacatttccctatggaaaattatcaaaacgaacaagaggaaatgaagaacatgacgagacaagaatatgtagctcatttacgaaggaaaagcagcggattctcaagaggggcctccatgtacagaggagtaacaaggtctcacaggctagcatttacacagcaccaccaa

SEQ ID NO: 2937 - DNA, 292 bp, Glycine max
ggagtgtggactttaaaagggtactctataagtttgttgcttgtgatatttgtactttgttcatgtgctgtggtgtgtgttgttgttgagagagtttgagaaagaataatgggaagaacaccatgttgtgacaagaagggtttgaagaaaggaccttggacagctgaagaggatgaaattctttctagttatatcaagaaaaatggtggtcatggaagctggcgttctcttccaaggatggcaggtcttcttcgttgtggcaagagttgcaggcttaggtggacaaactatc

SEQ ID NO: 2938 - DNA, 274 bp, Glycine max
gaacgatcccaccaccgataaactcatcatgtggggcccagccaacaacagcttcatcgtcctcgaccccctcgacttctctcactccctcctccctgctttcttcaagcacaacaacttctccagcttcgttcgacaactcaacacttatggtttcagaaaggtggatccggatcggtgggaattcgcaaatgagtggttcctgcgaggacagaagcacttgttgagaaacatcgcgcggaggaagcacggtggagctgggaggagcaatttc

SEQ ID NO: 2939 - DNA, 280 bp, Glycine max
gcagctgaagcctatgacattgctgctattaaattcagaggatttaatgctgttacaaactttgatataacaagatatgacgtggaaagaattatggagagcaataaccttcttagtagtgaacaagctaagcggaaaagagagatggatgatggaactagaagcgaggctacagttaaccaaaaaccttgtactactcaagaaaccgttctgatgcagaaaagatgcagaagccaatcagaatggaagatggttcagtatccatcctcccaacagcttg

SEQ ID NO: 2940 - DNA, 266 bp, Glycine max
ggggaacaaccacaacaacaaatttttcaattagctactatgagtaagatttggaataaatgaagcacatgactaggcaagagtacgttgcgtcattgagaaggaagagtagtgggttttctcgcggtgcatccatttatcgaggagtgacgagacacctccaacatggaaggtggcaagcgaggattggaagagttgctggcaacaaggatctttacttgggaacttttagcacccaagaagaggcagcggaagcatatgatgta

SEQ ID NO: 2941 - DNA, 272 bp, Glycine max
tacggctgcgagaagacgacagaagggcacacacaaaatctgtcataaacaaaagacttgatggggtttgtgtgtgtattacctatggccgctgcagaactcatacagcttgccacggttggagaagataataagggcaacctcagcatcacagaggccagagagttcataagcctctttgagcgaaccattcgtccactgtgcaaatgtcacctgacggtttctctggttctcaatcctcttcagctccacctttccgctacgcatgttta

SEQ ID NO: 2942 - DNA, 188 bp, Glycine max
ctgcaagacgacagaaggggaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaattcaaaagaagaaccttgtcaacttgg

SEQ ID NO: 2943 - DNA, 276 bp, Glycine max
acgggctgcgagaagacgacagaagggggtggtaatgagtggtgaagatgggcaaagcaccttgttgtgagaaacatggggtcagaaggggagcttggacacccgaagaagaccaagctttggttgactacatccagaaacatggccatggaagttggcgttcactccccaaacatgcaggtctcctaagatgtggaaaaagttgtcggcttcggtggataaactatcttcgcccaggcatcaagcgtggcccatttactagtgaagaagaaagta

SEQ ID NO: 2944 - DNA, 278 bp, Glycine max
tctcgagccgaatcggctcgagagatcctgttgatatggatgaagacgaaaaggagatgcttactgaagcacgagcccggttacgccaacacaaaaggaaagaaagcaaaaaggaaagctagggagaaacagcttgaggaagccaggagcgcttgcttctttacaaaagaagagagaattgaaggctgctggaattgatattaggcagcggaagagaaaaaggaaaggaatagattacaatgcagaaattccatttgaaaaaaggcctcctccagggt

SEQ ID NO: 2945 - DNA, 258 bp, Glycine max
gttctaactcctcttgtgctatataaagaagtagaaaagtcaccacagtgtttatcactgtttccactttctccaaaaatcggaagatcaccatgctgtgacaaggtgggtttaaagaagggtccgtggacgccagaggaagatcagaagctcttggcttatattgaagaacatggccatggaagctggcgtgctttgccagcaagctggacttcagaggtgtggcaaaagttgcaggttgagatggactaattatct

SEQ ID NO: 2946 - DNA, 257 bp, Glycine max
tttcgcttcatggctggtctcatcgatctcaacaacgccaccgaggacgatgaaacgccgtcgtctggctcctcctcctcctccataatcctccaccgtctgccttgaactctggcacgcttgcgcgggtccaatgatttcattgcccaagaaagggagcgttgtcgtgtacttccctcagggacacttggagcaacacctccacgattttccgctccctgcctctgccaacatcccttcccatgtcttctgtcgcg

SEQ ID NO: 2947 - DNA, 266 bp, Glycine max
ctcatctattctcgcctcagctttcactccaaacccttcccaaaccctaaccaaccacctcacccctctcgatctctttcgccgatccccgaaaccttccctatccgataattgacatttcgccgccgaattttttgggaggaacaaatccacgatggcggcctcctccaccagccaggtctacatccaggtaatcgacgatgtcatgatcaaggtccgcgacgagttcgtcaacaacggtggtcccggcgatgaagttctcaagg

SEQ ID NO: 2948 - DNA, 271 bp, Glycine max
  unsure (1)..(271): unsure at all n locations
ctgatgtatataggaacgttcatgaatatggtaaccggtactgcaagggttgagnntttggagtttatcaaggtgcaagtaaccatgaagagttgcacaacttgatcaaggcaacagtgatgattcgcaggcttaaaaaggcgttctttctcaacttcctgtaaagcgcaggcaacaagtcttcctagacttggctggcaaggacatgaagcaaattaatgctttatttcgagagttggagatggttaaagccaaaattaaggcagctaaa

SEQ ID NO: 2949 - DNA, 178 bp, Glycine max
tcccaccactgagcttacacgagcttcacaaagacgaatcggcgaaaaattgatcgaagatcgccggttcggttacaactgggccaaacggcacctcacaacaaacaacaaggctcgtcacaacacaacaaccacacatgacaaaacgcttcagagcaccgtgaagacaatacgggtg

SEQ ID NO: 2950 - DNA, 253 bp, Glycine max
ggatcaacaatctgtctcatgatgtcgctcttgccgtcgctcccgatgtcgaataccgcatgcgccagattatgcaggaggcaattaagtgcatgcgccattccaagagaaccactttgacggcagatgatgtcgatgctgcactcaacttgaagaatgttgaaccaatatatggatttgcatctggtggccctttacggttcaaaagagctgttggacacagagacttgttttatattgatgacaaggatgt

SEQ ID NO: 2951 - DNA, 268 bp, Glycine max
  unsure (1)..(268): unsure at all n locations
gttgtaagagtttcaataaatccacttcaactgaatcctagtgctgaagaaatggggcatggacgctatccaggtcaaccccaaggccatgctctctttcaaccattngactgtgagccaaccttacaaattggatatcatcctgatccagtatcagtggtgtcagaaggcccaagcatgaataattacatggcaggatggttaccatgaaagagtgtcaagtgtggagcataattaaagatcgatcctgccgtttcaaatctatttc

SEQ ID NO: 2952 - DNA, 248 bp, Glycine max
gttcccaagcttgctgggcttcggcgttgtggtaagagttgtcgtcttcgttggactaattatctaaggcctgacttgaagagagggctcctcacacaggctgaagagcagcttgttatcgatctccatgcccgtcttggcaacaggtggtccaagattgctgccaggttaccaggtaggacagacaacgaaattaaaaatcactggaacacccacatcaagaaaaagctccttaagatgggtattga

SEQ ID NO: 2953 - DNA, 276 bp, Glycine max
  unsure (1)..(276): unsure at all n locations
aanaaaggacaaaggaaagtaaataaaatataaagatggcagatgatgaatatagtttctgatgcataaaccacgatggatgaaagttgattcaggttgcaaacatggcttttccagacccatccatgtcagtttctccacagaggaagatgggaagggggaagattgagatcaagaggattgagaacactaccaatcgccaagtcacattctgcaagcgcaggaacggcttgctcaagaaagcatatgagttatctgtgctttgtgatgcagagg

SEQ ID NO: 2954 - DNA, 268 bp, Glycine max
gtgttcagttaagagtttccgcgtgagagtggccatgggaagagctccttgttgtgacaaagcaagcgttaagagagggccatggtctccaggagaagatgctacactcaaaaattatgtagagactcatggcactggtggaaattggattgcattgcccaaaaaagctggccttagacggtgtggcaagagttgccggctacggtggctcaattatctgatgccagacatcaaacatggaggctttactgaagaagaggacaacatc

SEQ ID NO: 2955 - DNA, 248 bp, Glycine max
ctctttcctcttcttcttcttctttctttcttccgccactgcagcagagcgtagaaggaaatcaaacagcagagagagggtaaagcatacgtgggttaaatccatgcgcatgagtcggaagaatttgtgttagcggtgaggagatatattgagaattaatatttgatagtgtatatatggggaggggaagagtggagttgaagaggatcgagaacaagatcaataggcaagtgacgttccaaagagaa

SEQ ID NO: 2956 - DNA, 280 bp, Glycine max
attcctctttcctcttcttcttcttctttctttcttccgccactgccgcagagcgtagaaggaaatcaaacagcagagagagggtaaagcatacgtgggttaaatccatgcgcatgagtcggaagaatttgtgttagcggtgaggagatatatcgagaattaatatttgatagtgtatatatggggaggggaagagtggagttgaagaggatcgagaacaagatcaataggcaagtgacgttctcaaagagaaggtctggtttgctgaagaaagcgcgcg

SEQ ID NO: 2957 - DNA, 269 bp, Glycine max
gctaagtggcaaagaaagaaagaaagaaaatttcaagggctgaaacatctatctttaactgtattctccctttgtttcctcaccagttgattcacgttgcaaacatggcttttccagacccatccatgtcagtttctccacagaggaagatgggaagggggaagattgagatcaagaggattgagaacactaccaatcgccaagtcacattctgcaagcgcaggaacggcttgctcaagaaagcatatgaattatctgtgctttgtgat

SEQ ID NO: 2958 - DNA, 263 bp, Glycine max
ctccttcctgttctgctaagtggcaaagaaagaaagaaagaaaatttcaagggctgaaacatctatctttaactgtattctccctttgtttcctcaccagttgattcaggttgcaaacatggcttttccagacccatccatgtcagtttctccacagaggaagatgggaagggggaagattgagatcaagaggattgagaacactaccaatcgccaagtcacattctgcaagcgcaggaacggcttgctcaagaaagcatatg

SEQ ID NO: 2959 - DNA, 302 bp, Glycine max
  unsure (1)..(302): unsure at all n locations
ctccttcctgttctgctaagtggcaaagaaaganagaaagaaaatntcaagggctgaaacatctatctttaactgtattctccctttgtttcctcaccagttgattcaggttgcaaacatggcttttccagacccatccatgtcagtttctccacagaggaagatgggaagggggaagattgagatcaagaggattgagaacactaccaatcggcaagtcacttctgcaagcgcaggaacggcttgctcaagaaagcatatgaattatctgtgctttgtgatgcagaggttgctctcattgt

SEQ ID NO: 2960 - DNA, 247 bp, Glycine max
gtgagtctatgttatttgtggcggacatgaactcctccaccaacacctcgaattctcagtcaatggctgcagcagccagtgatgggtctgggaagaaggtaagaaaaccttacaccataaccaagtccagggagagttggactgaggaagagcacgacaagtttctcgaagctcttcaattatttgacagggactggaagaacattgaagattttgtaggttcaaaaacagttattcagattcgaag

SEQ ID NO: 2961 - DNA, 259 bp, Glycine max
tgttgaaactgtgagtctatgttatttgtggcggagatgaactcctccaccaacacctcgaattctcagtcaatggctgcagcagccagtgatgggtctgggaagaaggtaagaaaaccttacaccataaccaagtccagggagagttggactgaggaagagcacgacaagtttctcgaagctcttcaattatttgacagggactggaagaaaattgaagattttgtaggttcaaaaacagttattcagattcgaagcc

SEQ ID NO: 2962 - DNA, 254 bp, Glycine max
ctctctctctctctctctctctctctctaagctctttcttgttgaaactgtgagtctatgttatttgtggcggagatgaactccaccaccaacacttcgaattctcagtcaatggctgcagcagcaccgatgatggttctgggaagaaggtaagaaagccttacaccataaccaagtccagagagagttggactgaggaagaacatgataagtttctcgaagctctccaactatttgacagggactggaagaaa

SEQ ID NO: 2963 - DNA, 262 bp, Glycine max
  unsure (1)..(262): unsure at all n locations
aaactgtgagtctatgttatttgtngcggagatgaactcctccaccaacacctcgaattctcagtcaatggctgcagcagccagtgatgggtctgggaagaaggtaagaaaaccttacaccataaccaagtccagggagagttggactgaggaagagcacgacaagtttctcgaagctcttcaattatttgacagggactggagaaaattgaagattttgtaggttcaaaaacagttattcagattcgaagccatgctcaga

SEQ ID NO: 2964 - DNA, 243 bp, Glycine max
ccaggctcttatgttggtgaagttgtcaaagtcatgggcaagaacaaagtccttgtgaaggtccacccagaaggaaaatatgtcgttgatattgacaaaagtattgacattacaaagattactccatccactagagttgcacttcgcaacgacagttatgttcttcacttagttctgccaagtaaagttgatccattggtcaatctgatgaaagttgagaaggttcccgattctacttacgac

SEQ ID NO: 2965 - DNA, 244 bp, Glycine max
caaaaatattgacattacaaagattactccatccactagagttgcactccgcaacgacagttatgttcttcacttagttctgccaagtaaagttgatccattggtcaatctgatgaaagttgagaaagttcccgattctacatatgacatgattggtggtttagaccagcaaattaaagaaatcaaagaggtcattgagctaccaatcaaacatcctgagctgtttgaaagtcttggaattgca

SEQ ID NO: 2966 - DNA, 267 bp, Glycine max
  unsure (1)..(267): unsure at all n locations
taatgggcaagaacaaagtccttgtcaaggtccacccagaaggaaaatatgttgttgacattgacaaaaatattgacattacaaagattactccatccactagagttgcantccgcaacgacagntaagttcttcacttanntctggcaagtaaagttgatccattggtcaatcngatgaaagttgagaaagttcccgattctacatatgacatgattggtggtttagaccagcaaattanagaaataaaagaggtcattgagctac

SEQ ID NO: 2967 - DNA, 281 bp, Glycine max
agttgtcaaagtcatgggcaagaacaaagtccttgtcaaggtccacccagaaggaaaatatgtcgttgatattgacaaaagtattgacattacaaagattactccatccactagagttgcacttcgcaacgacagtcatgttcttcacttagttctgccaagtaaagttgatccattggtcaatctgatgaaagttgagaaggttcccgattctacttacgacatgattggtggtttagaccagcaaattaaagaaataaaagaggtcattgagtaccaat

SEQ ID NO: 2968 - DNA, 248 bp, Glycine max
gtcaaggtccacccagaaggaaaatatgtcgttgatattgacaaaagtattgacattacaaagattactccatccactagagttgcacttcgcaacgacagtcatgttcttcacttagttctgccaagtaaagttgatccattggtcaatctgatgaaagttgagaaggttcccgattctacttacgacatgattggtggtttagaccagcaaattaaagaaataaaagaggtcattgagttaccaat

SEQ ID NO: 2969 - DNA, 268 bp, Glycine max
acggctgcgagaagacgacataaggggtcatgggcaagaacaaagtccttgtcaaggtccacccagaaggaaaatatgtcgttgatattgacaaaagtattgacattacaaagattactccatccactagagttgcacttcgcaacgacagttatgttcttcacttagttctgccaagtaaagttgatccattggtcaatctgatgaaagttgagaaggttcccgattctacttacgacatgattggtggtttagaccagcaaattaa

SEQ ID NO: 2970 - DNA, 253 bp, Glycine max
  unsure (1)..(253): unsure at all n locations
ctttaaagctttgggacctgaacaaaaccagctcttctggtttgtcatctgatgcttgtnccatgacctttaaaggtcatagtaatgaaaagaatttcgtgggattatctgttttggatggatacattgcatgtggttcagaatctaatgaggtgtactgttatcacaaatcactgcctgtgccaattgctactcataaatttgagtcaattgatcacatttctggtcatctaaatagtggtgataataatgg

SEQ ID NO: 2971 - DNA, 265 bp, Glycine max
ctcgagccgtttttggatcagctgattacaaggtttatggttatgatcttcgtcacactagaatcccttggtgcacattagctggtcatggcaaagctgttagctatgtaaaatttatagattctgaagcagttgtctctgcttccactgacaactctttaaagctttgggacctgaacaaaaccagctcttctggtttgtcatctgatgcttgtgccatgacctttaaaggtcatagtaatgaaaagaatttcgtgggattatc

SEQ ID NO: 2972 - DNA, 276 bp, Glycine max
  unsure (1)..(276): unsure at all n locations
ttctcttctcattaacacactacgcgtgcaaagaacctctgctctcctcttgcttttgatanagaagaaagaagcgagaagatgtcagangcgttctgcagcgactgcaagaggcagacggaggtggtgtttgaccactctgccggcgacacggtgtgctcggagtgcggcctcgtactggagtcccactctatcgacgagaccttgagtggcgtaccttcgccaacgagtccggtgacaagatcccaatcgtgtcggcgggccctccaaccccct

SEQ ID NO: 2973 - DNA, 272 bp, Glycine max
cattaacacactacgcgtgctaagaacctctgctctcctcttgcttttgatagagaagaaagaagcgagaagatgtcagacgcgttctgcagcgactgcaagaggcagacggaggtggtgtttgaccactctgccggcgacacggtgtgctcggagtgcggcctcgtactggagtcccattctatcgacgagacctctgagtggcgtaccttcgccaacgagtctggtgacaacgatcccaatcgtgtcggcgggccctccaaccccctcct

SEQ ID NO: 2974 - DNA, 251 bp, Glycine max
ctcttctcattaacacactacgcgtgcaaagaacctctgctctcctcttgcttttgatagagaagaaagaagcgagaagatgtcagacgcgttctgcagcgactgcaagaggcagacggaggtggtgtttgaccactctgccggcgacacggtgtgctcggagtgcggcctcgtactggagtcccatctatcgacgagacctctgagtcgcgtaccttcgccaacgagtccggtgacaacgatcccaatcg

SEQ ID NO: 2975 - DNA, 252 bp, Glycine max
ctctcctcttgcttttgatagagaagaaagaagcgagaagatgtcagacgcgttctgcagcgactgcaagaggcagacggaggtggtgtttgaccactctgccggcgacacggtgtgctcggagtgcggcctcgtactggagtcccactctatcgacgagacctctgagtggcgtaccttcgccaacgagtccggtgacaacgatcccaatcgtgtcggcgggccctccaaccccctcctcaccgacggcgg

SEQ ID NO: 2976 - DNA, 251 bp, Glycine max
ctctgctctcctcttgcttttgatagagaagaaagaagcgagaagatgtcagacgctgtctgcagcgactgcaagaggcagacggaggtggtgtttgaccactctgccggcgacacggtgtgctcggagtgcggcctcgtactggagtcccactctatcgacgagacctctgagtggcgtaccttcgccaacgagtccggtgacaacgatcccaatcgtgtcggcgggccctccaaccccctcttcaccga

SEQ ID NO: 2977 - DNA, 262 bp, Glycine max
aaagaagcgagaagatgtcagacgcgttctgcagcgactgcaagatgcagacggaggtggtgtttgaccactctgccggcgacacggtgtgctcggagtgcggcctcgtactggagtcccactctatcgacgagacctctgagtggcgtaccttcgccaacgagtccggtgacaacgatcccagtcgtgtcggcgggccctccaaccccctcctcaccgacggcggcctgtccaccgtcatcgccaagcccgacggcggcgg

SEQ ID NO: 2978 - DNA, 268 bp, Glycine max
gccacgcgtccgattaacacactacgcgtgcaaagaacctgtgctctcctcttgcttttgggagagaagaaagaagcgagaagatgtcagacgcgttctgcagcgactgcaagaggcagacggaggtggtgtatgaccactctgccggcgacacggtgtgctcggagtgcggcctcgtactggagtcccactctatcgacgagacctctgagtggcgtaccttcgccaacgagtccggtgacaacgatcccaatcgtgtcggcgggcc

SEQ ID NO: 2979 - DNA, 259 bp, Glycine max
tgggagttcttgaccgctctcctcctttttagttcttccccttaatcttctttcttcacaatttttatttccttccttattagacgtattagatcagattgaacaaaagggtttttctttctttctttcttggggaataatagaaataagaaaagattagtgaggttgaaatgtcgcaacgatcggtgctggcgccgttcttgacgaagacgtatcagttggtggaggatcaggggacggaccaggtgatatcgtgggg

SEQ ID NO: 2980 - DNA, 244 bp, Glycine max
ccttaatcttctttcttcacaatttttatttccttccttattagacgtattagatcagattgaacaaaagggtttttctttctttctttcttggggaataatagaaataagaaaagattagtgaggttgaaatgtcgcaacgatcggtgccggcgccgttcttgacgaagacgtatcagttggtggaggatcaggggacggaccaggtgatatcgtggggtgaaagtgggaacacttttgtggt

SEQ ID NO: 2981 - DNA, 255 bp, Glycine max
  unsure (1)..(255): unsure at all n locations
aggaaatgaattcaaacgtgaaggttcaggacgtggtaactggggagcccaaactgatgaacttgctcaggtaactgatgaggttgcgaatgaaactgaaaagaatttgggtgatgagaagcctgcagttgaagaagatgtagctgatggtaacaaggacagccctactaatgaaactgaagaaaaannncctgaagataaggagatgactctggangnnnnngaaaaagtgttggaagagagaaggaaggcctt

SEQ ID NO: 2982 - DNA, 275 bp, Glycine max
aggtaatgaattcaaacgtgaaggttcaggacgttttaactggggagcccaaactgatgaacttgctcaggtaactgatgaggttgcgaatgaaactgaaaagaattagggtgatgagaagcctgcagttgaagaagatgtagctgatggtaacaaggacagccctactaatgatactggagagaaagagcctgaagataaggagatgactctggaggaatatgaaaaagtgttggaagagagaaggaaggccttccaagcactcaagactgaag

SEQ ID NO: 2983 - DNA, 255 bp, Glycine max
ggggaagagaaaaagaactagctagcttgctagagtgtgagaactctagcatatactagtactactacattccttcatcttcctttttatttttcaccataaaaaaacaagagcacaaagatggtgagagctccttgttgtgaaaagatgggtttgaagaagggtccttgggctaccgaggaagatcaaattctcacatcttacatccaaaaacatggccatggcaattggcgtgccctcacaaagcaagcaggc

SEQ ID NO: 2984 - DNA, 259 bp, Glycine max
aggggaagagaaaaagaactagctagcttgctagagtgtgagaactctagcatatactagtactactacattccttcatcttcctttttatttttcaccataaaaaaacaagagcacaaagatggtgagagctccttgttgtgaaaagatgggtttgaagaagggtccttgggctaccgaggaagatcaaattctcacatcttacatccaaaaacatggccatggcaattggcgtgccctcccaaagcaagcaggcctt

SEQ ID NO: 2985 - DNA, 250 bp, Glycine max
cgaagagaaaaagaactagctagcttgctagagtgtgagacatctagcatatactagtactactacattccttcatcttcctttttatttttcaccataaaaaaacaagagcacaaagatggtgagagctccttactgtgaaaagatgggtttgaagaagggtccttgggctaccgaggaagatcaaattctcacatcttacatccaaaaacatggccatggcaattggcgtgccctcccaaagcaagca

SEQ ID NO: 2986 - DNA, 247 bp, Glycine max
gaaagagagaaaagaactagctagctggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctccca

SEQ ID NO: 2987 - DNA, 216 bp, Glycine max
aaacaagaactagctagcctgctagagtgtgagaactctagcatatactagtactactacattccttcatcttcctttttatttttcaccataaaaaaacaagagcacaaagatggtgagagctccttgttgtgaaaagatgggtttgaagaagggtccttgggctaccgaggaagatcaaattctcacatcttacatccaaaaacatggccatgg

SEQ ID NO: 2988 - DNA, 276 bp, Glycine max
gaaaagaactagctagctggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgta

SEQ ID NO: 2989 - DNA, 276 bp, Glycine max
gatggagtctgagaactctagcatgtactagtactactcctacattcctccatcttcctttgtactatttttttttttaaccataaaagcaagagcacaaagatggtgagagctccttgttgtgaaaagatgggtttgaagaagggtccttggggtcccgaggaggatcaaatcctcacatcttacattgaaaaacatggtaatggacattggcgtgccctcccaaagcaagcaggcttgttaaggtgtgggaaaagctgtagactccgctggatt

SEQ ID NO: 2990 - DNA, 271 bp, Glycine max
tgctagagtgtgagatctctagcatatactagtactactacattcctccatcttcctttttatttttcaccataaaaaaaccagagcacaaagatggtgagagctccttgttgtgaaaagatgggtttgaagaagggtccttgggctaccgaggaagatcaaattctcacatcttacatccaaaaacatggccatggcaattggcgtgccctacccaaagcaagcaggccttctaaggtgtgggaaaagctgcagactccgctggattaac

SEQ ID NO: 2991 - DNA, 247 bp, Glycine max
cggctgcgagaagacgacagaagggggaagttgaagcggggaagagaaaaagaactagctagcttgctagagtgtgagaactctagcatatactagtactactacattccttcatcttcctttttatttttcaccataaaaaaacaagagcacaaagatggtgagagtccttgttgtgaaaagatgggtttgaagaagggtcattgggctaccgaggaagatcaaattctcacatcttacatccaaa

SEQ ID NO: 2992 - DNA, 422 bp, Glycine max
aattccaggccgaccgaccgtcagtacggctgcgagaagacgacagaagggggaagttgaaggggaaagagagaaaagaactagctagctggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatc

SEQ ID NO: 2993 - DNA, 421 bp, Glycine max
tacggctgcgagaagacgacagaagggggaagttgaaggggaaagagagaaaagaactagctagctggagtctgagaactctagcatgtactagtactactcctacattcctccatcttcctttgtactatttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgctgggg

SEQ ID NO: 2994 - DNA, 415 bp, Glycine max
cccacgcgtccgtccacgcgtccgcccacgcgttcgcccacgcgttcgaaagaactaggtaggtggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgc

SEQ ID NO: 2995 - DNA, 264 bp, Glycine max
ctccagcttcgttcgccaactcaacacctatggtttcagaaaggtggatccggatcggtgggagttcgcgaacgagtggttcctgcgaggacaaaagcacttattgaggaacatcgtgcggaagaagcacggtggagctgggaggaccaattccaattcgcattattcgcatcccttgaagctggaggagttggacgacgaggctatggtgatggagatagcgaggttgaaggaggagcaaaaagcgttggaggaagagcttca

SEQ ID NO: 2996 - DNA, 264 bp, Glycine max
gctcgatctccagcttcgttcgccaactcaacacctatggtttcagaaaggtggatccggatcggtgggagttcgcgaacgagtggttcctgcgaggacaaaagcacttattgaggaacatcgtgcggaagaagcacggtggagctgggacgaccaattccaattcgcattattcgcatcccttgaagctggaggagttggacgacgaggctatggtgatggagatagcgaggttgaaggaggagcaaaaagcgttggaggagg

SEQ ID NO: 2997 - DNA, 258 bp, Glycine max
  unsure (1)..(258): unsure at all n locations
gtgagatcatactgttcggagtcagagtcgtcgtcgattccatgaggaagagcgtcagcatnagcaacctctcacagtacgagcatcctcaagacggcagcaacaacaaagacgctctcgccgccggttacgcctccgccgacgacgccgctcctcagaactccggccgcctccgggagcgcgaggagaagnaggagttccgtggacggaggaagagcacaagctgtttttggttggattgcagaaggtagggaaagg

SEQ ID NO: 2998 - DNA, 236 bp, Glycine max
gtcagagtcgtcgtcgattccatgaggaagagcgtcagcatgagcaacctctcacagtacgagcatcctcaagacggcagcaacaacaaagacgctctcgccgccggttacgcctccgccgacgacgccgctcctcagaactccggccgcctccgggagcgcgagcgaaagcgaggagttccgtggacggaggaagagcacaagctgtttttggttggattgcagaaggtagggaa

SEQ ID NO: 2999 - DNA, 335 bp, Glycine max
  unsure (1)..(335): unsure at all n locations
caagataataaagatgaattgaaaacaaaattaaaggagatacttcgtgaganatctgatgtattcaactcaaagaatgcctgaagaggataagattaaattgggagaacctggctggaaagagaggtattatgatgaaaaattttctgccaaaactcctgaggaacttgaagcgatacgtaagatgttgtcttgaaatacactgaagggctatgttgggtgatgcactattattatgaaggtgtttgttcttggaattggttttatccttatcactatgctccctttgcgtctgatctcaagggccttggtgaacttgatatagctttaactgg

SEQ ID NO: 3000 - DNA, 443 bp, Glycine max
cccacgcgtccgcagtgctctgtcttctcccccaccaccgcactctctcagatattatgatttgatatcacacattcacatcctatcatcatcgacaacacgctatccccattgcttcttctcttctccctctctcgtttcctacttgacggcgccgtttcgttctccagaagatgcttctgagtacttcgcgctgcaactagacatgatgagttcaagtttcaagacatgggctgtgggatttgcacttggaaatgaacgagaggcaacgttggagagctgaagaggatgctttattacgttcttatgtcaaacagtatggtcctagggaatggaatcttgtgtctcagcgcatgaacacatatcttaacagggatgctaagtcgtgcttggagaggtggaagaactacctcaagcctggcatcaaaaaaggctctcttact

SEQ ID NO: 3001 - DNA, 266 bp, Glycine max
gagcaatgtgtccaggcggaaaagacggtccagcttgtttgatattgttgcagatgaagcagctgacactgcaatggtacagcaagacttcttgtctgctaatcagttacccactgaaacagaaggcaataaccccttgccagctcctcctcccctcgacgaagagtgcgaatccatggattccacaaactcaaatgatggagagcctgccccatcaaagccagaaaacacacagtcatcttatccaatgttatatcctgcatatt

SEQ ID NO: 3002 - DNA, 237 bp, Glycine max
gatggattccacaaactcaaatgatggagagcctgccccatcaaagccagaaaacacacatccatcttatcctatgttatatcctgcgtattattctccagtgttcccgtttcctctgccctattggtcaggatacagtccagagcccaccaagaaggaggaaacacatgaagtgctgaaaccaactgcagtacattctaaaagccctatcaatgttgatgaactggttggcatatc

SEQ ID NO: 3003 - DNA, 266 bp, Glycine max
aatggattccacaaactcaaatgatggagagcctgccccatcaaagccagaaaacacacatccatcttatcctatgttatatcctgcgtattattctccagtgttcccgtttcctctgccctattggtcaggatacagtccagagcccaccaagaaggaggaaacacatgaagtgctgaaaccaactgcagtacattctaaaagcccaatcaatgttgatgaactggttggcatatcaaaactgagtttaggggagtctattggtg

SEQ ID NO: 3004 - DNA, 282 bp, Glycine max
tggattccacaaactcaaatgatggagagcctgccccatcaaagccagaaaacacacatccatcttatcctatgttatatcctgcgtattattctccagtgttcccgtttcctctgccctattggtcaggatacagtccagagcccaccaagaaggaggaaacacatgaagtgctgaaaccaactgcagtacattctaaaagccctatcaatgttgatgaactggttggcatatcaaaactgagtttaggggagtctattggtgactcgggtccctccaccc

SEQ ID NO: 3005 - DNA, 254 bp, Glycine max
ctgacttgcaggcagctgacactgcaatggtacagcaagacttcttgtctgctaatgagttaccaactgaaacagaaggcaataaccccttgcctgctcctcctcccctcgatgaagtgtgtgaatcaatggattccacaaactcaaatgatggagagcctgccccatcaaagccagaaaacacacatccatcttatcccatgttatatcctgcgtattattctccagtgttcccgtttcctctgccctattgg

SEQ ID NO: 3006 - DNA, 358 bp, Glycine max
cccacgcgtccgcccacgcgtccgcccacgcgtccgcccacgcgtccgctcaagtggccagccatgctcagaaatatttcatcaggcaaagcaatgtgtccaggcgaaaaagacggtccagcttgtttgatattgttgcagatgaagcagctgacactgcaatggtacagcaagacttcttgtctgctaatgagttaccaactgaaacagaaggcaataaccccttgcctgctcctccttccctcgatgaagagtggtgaatcaatgggattcacaaactcaaatgatggagagcctgccccatcaaagccagaaaacacacatccatcttatcctatgttatatcctgcgtattatt

SEQ ID NO: 3007 - DNA, 194 bp, Glycine max
  unsure (1)..(194): unsure at all n locations
cattcccttcttcaatttcatcaacacaaccatcaattncatcaaccatcgcataataatagtattatcatgatagccgtggcccgaaaggncatggaccggatcaagggcccgtggagcccggaggaggacgaggcccttcagaagcttgtggagcggcacgggcccagaaactggtcgctcatcagcaggtc

SEQ ID NO: 3008 - DNA, 269 bp, Glycine max
ctcaccaacaaccgcaaacacaaacacagacccttcccttccttcctccctccctcattcccttcttcaatttcatcaacacaaccatcaatttcatcaaccatcgcataataatagtattatcatgatagccgtggcccgaaaggacatggaccggatcaagggcccgtggagcccggaggaggacgaggcccttcagaagcttgtggagcggcacgggcccagaaactggtcgctcatcagcaggtccattccgggccggtctggga

SEQ ID NO: 3009 - DNA, 267 bp, Glycine max
caccaacaaccgcaaacacaaacacagacgcttcccttccttcctccctccctcattcccttcttcaatttcatcaacacaaccatcaatttcatcaatcatcgcataataatagtattatcatgatagccgtggcccgaaaggacatggaccggatcaagggcccgtggagcccggaggaggacgaggcccttcagaagcttgtggagcggcacgggcccagaaactggtcgctcatcagcaggtccattccgggccggtctggga

SEQ ID NO: 3010 - DNA, 265 bp, Glycine max
ccacaaaataactcaccaacaaccgcaaacacaaacacagacccttcccttccttcctccctccctcattcccttcttcaatttcatcaacacaaccatcaatttcatcaaccatcgcataataatagtattatcatgatagccgtggcccgaaaggacatggaccggatcaagggcccgtggagcccggaggaggacgaggcccttcagaagcttgtggagcggcacgggcccagaaactggtcgctcatcagcaggtccattc

SEQ ID NO: 3011 - DNA, 260 bp, Glycine max
cacaaaataactcaccaacaaccgcaaacacaaacacagacccttcccttccttcctccctccctcattcccttcttcaatttcatcaacacaaccatcaatttcatcaaccatcgcataataatagtattatcatgatagccgtggcccgaaaggacatggaccggatcaagggcccgtggagcccggaggaggacgaggcccttcagaagcttgtggagcggcacgggcccagaaactggtcgctcatcagcaggtcc

SEQ ID NO: 3012 - DNA, 284 bp, Glycine max
caaacacagacccttcccttccttcctccctccctcattcccttcttcaatttcatcaacacaaccatcaatttcatcaaccatcgcataataatagtattatcatgatagccgtggcccgaaaggacatggaccggatcaagggcccgtggagcccggaggaggacgaggcccttcagaagcttgtggagcggcacgggcccagaaactggtcgctcatcagcaggtccattccgggccggtctgggaagtcatgcaggcttcggtggtgcaaccagctgtcg

SEQ ID NO: 3013 - DNA, 238 bp, Glycine max
cggctcgagataactcaccaacaaccgcaaacacaaacacagacccttcccttccttcctccctccctcattcccttcttcaatttcatcaacacaaccatcaatctcatcaaccatcgcataataatagtattatcatgatagccgtggcccgaaaggacatggaccggatcaagggcccgtggagcccggaggaggacgaggcccttcagaagcttgtggagcggcacgggcccag

SEQ ID NO: 3014 - DNA, 206 bp, Glycine max
  unsure (1)..(206): unsure at all n locations
aaaaaacccgaacccgcccgagggattctacttggatcccagtggtggcatgcctcttcctgggatgcctcccttcgcctccgtctccgccgcaaccgctgcgaactcgccggaggacgccgccaagaagatccgcaagccctacaccatcaccaagtcgcgggagaannggaccgaacccgaacacgacaagttcctcgaagcaa

SEQ ID NO: 3015 - DNA, 265 bp, Glycine max
ctttctctctaaaatctttgaaaatggtatccaaaaacccgaacccgcccgagggattctacttggatcccagtggtggcatgcctcttcctgggatgcctcccttcgcctccgtctccgccgcaaccgctgcgaactcgccggaggacgccgccaagaagatccgcaagccctacaccatcaccaagtcgcgggagaactggaccgaacccgaacacgacaagttcctcgaagcaattcaactgtttgatcgtgattggaaaaa

SEQ ID NO: 3016 - DNA, 268 bp, Glycine max
gaaagaattgggggaatggagaacaaccagcaacaaggcgctcaagcccaatcgggaccgtaccccggcggcgcggtggaagtgcaggtgcaggtgcaggtgcaggcgcggccccgttccagcacctgctccagcagcagcagcagcagctgcagatgttctggtcgtaccagcggcaagagatcgagcacgtgaacgacttcaagaaccaccagctccctttggcccgcatcaagaagatcatgaaggccgacgaggacgtccgcat

SEQ ID NO: 3017 - DNA, 245 bp, Glycine max
ggctctctctctttctctcataaaaacactccgagtacaaagaccctctctcctctcctctttgcattcgagtgaaagaagcgaagacaaagaaacatgtcagacgcgttctgcagcgactgcaagaggcagacggaggtggtgttcgaccactccgccggcgacacggtgtgctcggagtgcggcctcgtcctcgaatcccactccatcgacgagacctccgagtggcgcaccttcgccaacga

SEQ ID NO: 3018 - DNA, 259 bp, Glycine max
ggctctctctctttctctcataaaaacactccgagtacaaagactctctctcctctcctctttgcattcgagtgaaagaagcgaagaaaaagaaacatgtcagacgcgttctgcagcgactgcaagaggcagacggaggtggtgttcgaccacttcgccggtgacacggtgtgctcggagtgcggcctcgtcctcgaatcccactccatcgacgagacctccgagtggcgcaccttcgccaacgagtccggcgacaacg

SEQ ID NO: 3019 - DNA, 256 bp, Glycine max
ctctttctctcataaaaacactccgagtacaaagacccgctcgcctctcctcgtggcattcgagtctaagaagcgaagaaagaataaacatgtcagacgcgttctgcagcgactgtaagaggcagacggaggtggtgttcgaccactccgccggcgacacggtgtgctcggagtgcggcctcgtcctcaatcccactccatcgacgagacctccgagtggcgcaccttcgccaacgagtccggcgataacgacccc

SEQ ID NO: 3020 - DNA, 275 bp, Glycine max
  unsure (1)..(275): unsure at all n locations
aaactcggagagaaagggtactagtacgtacctgcaggctgcagcaacctcgaagctagttcaaactagtgggangttgtgtgcatagaagcacaaacaaattacagaaaaagtcatcatcatactcaganttaatacaaattaagcattgatcttgaattaatggctcgcggaaagnttcagctgangcgaattgagaaccctgtgcacaggcaagttaccttctgcaagcgccgagctgggctctaagaaggctaaggagctctctgtgcgtg

SEQ ID NO: 3021 - DNA, 272 bp, Glycine max
gagataaaactcggagagaaagggtactagtacgtacctgcaggctgcagcaacctcgaagctagttcaaactagtgggaggttgtgtgcatagaagcacaaacaaattacagaaaaagtcatcatcatactcagaattaatacaaattaagcattgatcttgaattaatggctcgcggaaaggttcagctgaagcgaattgagaaccctgtgcacaggcaagttaccttctgcaagcgccgagctgggcttcttaagaaggctaaggagct

SEQ ID NO: 3022 - DNA, 295 bp, Glycine max
  unsure (1)..(295): unsure at all n locations
atccgttccaaaccacataagcttcaacaaagatggatgtagaaaagttgaagaagatggccagttctgttcgaactggtgggaagggtactatgagaaggaagaagaaagctgtccacaagactactactacagatgacaaaaggcttcaaagcaccctgaagaggataggngtgaatgctatccctgcaattgaagaagtcaacatctttaaggatgaaatagttatccagtttttaaaccccaaagtacaagcatctattgctgccaacnttgggttgttagtggttcacca

SEQ ID NO: 3023 - DNA, 236 bp, Glycine max
  unsure (1)..(236): unsure at all n locations
cacagtctcttacatataaagggaagtccttatcttatagtatcggttagctcttccatttcgcaatccgttccaaaccacataagcttcaacaaagatggatgtagaaaagttgaagaagatggccagtnctgtncgaactggtgggaagggtactatgagaaggaagaagaaagctgtccacaagactactactacagatgacaaaaggcttcaaagcnaccctgaagaggata

SEQ ID NO: 3024 - DNA, 279 bp, Glycine max
cggctcgagcgcaatccgttccaaaccacataagcttcaacaaagatggatgtagaaaagttgaagaagatggccagttctgttcgaactggtgggaagggtactatgagaaggaagaagaaagctgtccacaagactactactacagatgacaaaaggcttcaaagcaccctgaagaggataggagtgaatgctatccctgcaattgaagaagtcaacatctttaaggatgaaatagttatccagtttttaaaccccaaagacaagcatctattgctg

SEQ ID NO: 3025 - DNA, 243 bp, Glycine max
ataagcttcaacaaagatggatgtaataaagttgaagaagatggccagttctgttcgaactggtgggaagggtactatgagaaggaagaagaaagctgtccacaagactactactacagatgcaaaaggcttcaaagcacgctgaagaggataggagtgaatgctatccctgcaattgaagaagtcaacatctttaaggatgaaatagttatccagtttttaaaccccaaagtacaagcatct

SEQ ID NO: 3026 - DNA, 265 bp, Glycine max
gggaagtccttatcttatagtatcggttagctcttccatttcgcaatccgttccaaaccacataagcttcaacaaagatggatgtagaaaagttgaagaagatggccagttctgttcgaactggtgggaagggtactatgagaaggaagaagaaagctgtccacaagactactactacagatgacaaaaggcttcaaagcaccctgaagaggataggagtgaatgctatccctgcaattgaagaagtcaacatctttaaggatga

SEQ ID NO: 3027 - DNA, 265 bp, Glycine max
cctcgagccgaatcggctcgagtttcgcaatccgttccaaaccacatcagcttcaacaaagatcgatgtagaaaagttgaagaagatggccagttctgttcgaactggtgggaagggtactatgagaaggaagaagaaagctgtccacaagactactactacagatgacaaaaggcttcaaagcaccctgaagaggataggagtgaatgctatccctgcaattgaagaagtcaacatctttaaggatgaaatagttatccagttt

SEQ ID NO: 3028 - DNA, 276 bp, Glycine max
cctcgagccgaatcggctcgagtttcgcaatccgttccaaaccacaacagcttgcacaaagaacgatgtagaaaagttgacgacgatggccagttctgttcgaactggtgggaagggtactatgagaaggaagaagaaagctgtccacaagactactactacagatgacaaaaggcttcaaagcaccctgaagaggataggagtgaatgctatccctgcaattgaagaagtcaacatctttaaggatgaaatagttatccagtttttaaaccccaa

SEQ ID NO: 3029 - DNA, 277 bp, Glycine max
ttcgcaatccgttccaaaccacatagctttaacaaagatggatgtagaaaagttgaagaagatggccagttctgttcgaactggtgggaagggtactatgagaaggaagaagaaagctgtccacaagactactactatagatgacaaaaggcttcaaagcaccctgaagaggataggagtgaatgctatccctgcaattgaagaagtcaacatctttaaggatgaaatagttatccagtttttaaaccccaaagtacaagcatctttgctgccaaca

SEQ ID NO: 3030 - DNA, 263 bp, Glycine max
aaaccacataagcttcaacaaagatggatgtagaaaagttgaagaagatggccagttctgttcgaactggtgggaagggtactatgagaaggaagaagaaagctgtccacaagactactactacagatgacaaaaggcttcaaagcaccctgaagaggataggagtgaatgctatccctgcaattgaagaagtcaacatctttaaggatgaaatagttatccagtttttaaaccccaaagtacaagcatctattgctgccaac

SEQ ID NO: 3031 - DNA, 291 bp, Glycine max
acgtacggctgcgagaagacgacagaaggggataaaaaagtgatttagggtttttgcacagtctcttacatataaagggaagtccttatcttatagtatcggtcagctcttccatttcgcaatccgttccaaaccacataagcttcaacaaagatggatgtagaaaagttgaagaagatggccagttctgttcgaactggtgggaagggtactatgagaaggaagaagaaagctgtccacaagactactactacagatgacaaaaggcttcaaagcaccctgaagaggata

SEQ ID NO: 3032 - DNA, 281 bp, Glycine max
  unsure (1)..(281): unsure at all n locations
cgcttgcttaccaacagaaccaaaagannattacacaaacantaattaacacactgagtcttaagtttctctgtttatcacaaagatggtgagaaccctctcttgtgacaaaagtggaacgaggaaaggtacttggactccggaggaagatagaaagttaattgctatgtcactagatatggctcctggaattggcgccaattcccaggtttgctggtctggcaagatgtggcaaaagttgtagactgagatggatgaattatctaaggccaaatgtcaaa

SEQ ID NO: 3033 - DNA, 274 bp, Glycine max
  unsure (1)..(274): unsure at all n locations
cacaaagatggtgagaaccccatcttgtgacaaaagtggaacgaggaaaggtacttggactccggaggaagatagaaagttaattgcttatgtcactagatatggctcctggaattggcgccaacttcccaggtttgctggtctggcaagatgtggcaaaagttgtagactgagatggatgaattatctaaggccaaatgtcaaaagagggaacttcactcaacaagaagatgantgcatcattagaatgcacaaaaaactggtaacaaatggt

SEQ ID NO: 3034 - DNA, 249 bp, Glycine max
cgtatgcggctcgagcaaacactaattaacacactgagtcttaagtttctctgtttatcacaaagatggtgagaaccccatcttgtgacaaaagtggaacgtggaaaggtacttggactccggaggcagatagaaagttaattgcttatgtcactagatatggctcctggaattggcgccaacttcccaggtttgctggtctggcaagatgtggcaaaagttgtagactgagatggatgaattatctaa

SEQ ID NO: 3035 - DNA, 189 bp, Glycine max
agagaattacacaaacactaattaacacactgagtcttaagtttctctgtttatcacaaagatggtgagaaccccatcttgtgacaaaagtggaacgcggaaaggtacttggactccggaggaagatagaaagttaattgcttatgtcactagatatggctcctggaattggcgccaacttcccaggtt

SEQ ID NO: 3036 - DNA, 252 bp, Glycine max
gtaaaaggatgctgttgctacaaatcggaccctggatttgacatctggttttgaagttggtcctgcaacaactgctggtgcagatgcatcatcaagtcaaaacactcgatcggtgttgactattgccttccagttcccttttgacagcagtctgcaagacaacgtcgcggtcatggcacgccaatatgtccgcagtgtgatttcctccgtgcagagggttgccatggctatatctccatctggtataaaccc

SEQ ID NO: 3037 - DNA, 265 bp, Glycine max
cctatatgcacgaatcacgccatctccatgcaatgcggcgaccaagaggatgtgggggtcgcttcttgaacactaagaattctgttgacggaaatggtaaaattggaaatgaagtgcataaaactgttggtgaacaattgcagtctagtggctctcagagttctgaattccttcaatctgaggttggaacttttaattcatcaaaagagactaatggaagcagtccaaatatttctggttcagaggtgactagcatgtattcgcg

SEQ ID NO: 3038 - DNA, 226 bp, Glycine max
gccctatatgcacgaatcacgccatctccatgcaatgcggcgaccaagaggatgtgggggtcgcttcttgaacactaagaattctgttgacggaaatggtaaaattggaaatgaagtgcataaaactgttggtgaacaattgcagtctagtggctctcagagttctgaattccttcaatctgaggttggaacttttaattcatcaaaagagactaatggaagcagt

SEQ ID NO: 3039 - DNA, 435 bp, Glycine max
cacgcgtccaacagcttttgttctagcacttcgctgtctgaggttctggattctcagtgtttgcggagcgcagcgtcatcttttagggaagaatggatcatcaagggcatagccagaacccatctatgggggttgttggtagtggagctcaattagcatatggttctaacccatatcagccaggccaaataactgggccaccggggtctgttgtgacatcagttgggaccattcaatccaccggtcaacctgctggagctcagcttggacagcatcaacttgcttatcagcatattcatcagcaacaacagcaccagcttcagcaacagctccaacaattttggtcaagccagtaccaagaaattgagaaggttactgattttaagaaccacagtcttcccctggcaaggatcaagaagattatgaacgctgacg

SEQ ID NO: 3040 - DNA, 201 bp, Glycine max
atccctttctgtgagggaattatggtaattgatatcgaggttttgactcatggattctgatcgccccagaaaaccttccaaaaatttagttcactctcgcttcttccttttcggcttctattgctgggattgggagttcttaaccgctctcctcctttttagttgttccccttaatcttgttccttctatttttttttttt

SEQ ID NO: 3041 - DNA, 270 bp, Glycine max
gggaattatggtaattgatatcgaggttttgactcatggattctgatcgccccagaaaaccttccaaaaatttagttcactctcgcttcttccttttcggcttctattgctgggattgggagttcttaaccgctctctcctttttagttgttccccttaatcttgttccttcatattttttttttttcttattagatcagattgaacaaaagggttgctctttattttttaatcttgggggaataatagtattagaactaagaaaagatt

SEQ ID NO: 3042 - DNA, 264 bp, Glycine max
ctgtactttatccctttctgtgagggaattatggtaattgatatcgaggttttgactcatggattctgatcgccccagaaaaccttccaaaaatttagttcactctcgcttcttccttttcggcttctattgctgggattgggagttcttaaccgctctcctcctttttagttgttccccttaatcttgttccttcatattttttttttttcttattagatcagattgaacaaaagggttgctctttattttttaatcttgggg

SEQ ID NO: 3043 - DNA, 275 bp, Glycine max
gttttgactcatggattctgatcgccccagaaaaccttccaaaaatttagttcactctcgcttcttccttttcggcttctattgctgggattgggagttcttaaccgctctcctcctttttagttgttccccttaatcttgttccttcatatttttatttttttttcttattagatcagattgaacaaaagggttgctctttattttttaatcttgggggaataatagaaatagaaataagaaaagattagtgaggttgaaatgttgcaacacga

SEQ ID NO: 3044 - DNA, 251 bp, Glycine max
  unsure (1)..(251): unsure at all n locations
cnccgttaccggcggancaaaccggtgaatcagcgccgacggagttgccagagatccattcccgacgccgtttctgancaagacgtaccagctcgtcgatgatccctccgcggatgacctaatttcctggaacgaagcacggcaccagcttcattgtatggcgacccgcggaatttgcaagggatttgcttcctaagtacttcaaacacaacaacttttccagtttcgtccgtcaacttaacacctatggg

SEQ ID NO: 3045 - DNA, 300 bp, Glycine max
ctttgaagcttagaaaagcggttaggtagctaggtttcagtttcagatctggtagagagcttcatcatgaagccattaccggcggagcaaaccggtgaatcagcgccgacggagttgcagagatccattccgacgccttttctgaccaagacgtaccagctcgtcgatgatccctccgcggatgacctaatttcctggaacgaagatggcaccagcttcatcgtttggcgacccgcggaattcgctagggatttgcttcctaagtacttcaaacacaacaactattccagtttcgtccgt

SEQ ID NO: 3046 - DNA, 265 bp, Glycine max
gaaactttgaagcttagaaaagcggttaggtagctaggttgagttccagatctggtagagaagttcatcatggcgccgttaccggcggagcaaaccggtgaatcagcgccgacggagttgcagagatccattccgacgccgtttctgaccaagacgtaccagctcgtcgatgatccctccgcggatgacctaatttcctggaacgaagacggcaccagcttcatgtatggcgacccgcggaatttgcaagggatttgcttcctaa

SEQ ID NO: 3047 - DNA, 357 bp, Glycine max
attttccttttggatttgataatattaagaggaaccaggatagataggtaggttctagcctttctgttatcattttcgaaacaaaccaaattgaaactgtttgagttttgtttagaaggctgttatgaatgaaactttgaagcttagaaaagcggttaggtagctaggtttcagtttcagatctggtagagagcttcatcatgaagccattaccggcggagcaaaccggtgaatcagcgccgacggagttgcagagatccattccgacgccttttctgaccaagacgtaccagctcgtcgatgatccctccgcggatgacctaatttcctggaacgaagatggcaccagcttcatcg

SEQ ID NO: 3048 - DNA, 383 bp, Glycine max
attttccttttggatttgataatattaagaggaaccaggatagataggtaggttctagcctttctgttatcattttcgaaacaaaccaaattgaaactgtttgagttttgtttagaaggctgttatgaatgaaactttgaagcttagaaaagcggttaggtagctaggtttcagtttcagatctggtagagagcttcatcatgaagccattaccggcggagcaaaccggtgaatcagcgccgacggagttgcagagatccattccgacgccttttctgaccaagacgtaccagctcgtcgatgatccctccgcggatgacctaatttcctggaacgaagatggcaccagcttcatcgtttggcgacccgcggaattcgctaag

SEQ ID NO: 3049 - DNA, 249 bp, Glycine max
atttttgcaaaatcagttactatttagggtccgacttactgagatcagattctcttgttggtgacatgatgctgaaacaactgtagcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacag

SEQ ID NO: 3050 - DNA, 239 bp, Glycine max
attcacttctctctctcaaaacaagttatggtagtatttgtcattcatttcacaaaaccggttcacctttggacccatggcttctaaaacccctaccttattccactctcgtttcttcctcttcggcttctattgctgggactgggaatttctcaccgctctcctcctctttagttcttcttcctaattaattaaattacatacaccttttcttttttttttttttacctaaattcctc

SEQ ID NO: 3051 - DNA, 255 bp, Glycine max
ctctctctcaaaacaagttatggtagtatttgtcattcatttcacaaaaccggttcacttttggacccttggcttctaaaacccctaccttattccactctcgtttcttcctcttcggcttctattgctgggactgggaatttctcaccgctctcctcctctttagttcttcttcctaattaattaaattacatacaccttttcttttttttttttaacctaaattccccattactacaacttcaacaaaagggg

SEQ ID NO: 3052 - DNA, 242 bp, Glycine max
ttcacttctctctctcaaaacaagttatggtagtatttgtcatccatttcacaaaaccggttcacctttggacccatggcttctaaaacccctaccttattccactctcgtttcttcctcttcggcttctattgctgggactgggaatttctcaccgctctcctcctctttagttcttcttcctaattaattaaattacatacaccttttcttattcgtttttttacctaaattccccataa

SEQ ID NO: 3053 - DNA, 278 bp, Glycine max
caaacacaccacagcaccaaactagttggctcaattctctttgaatggctttggaggctttgaattcaccaacagcagccaccactcccttccgtggttaccaagaagaggaggaggaggttgaccttcacctacgcgagccttgggccaagagaaaacgctccaaacgacctcgttttgagtcggaggaagagtacttggctctttgcctcatcatgcttgcacaaagcggtaacaacaacaacacccaattaccgtcttcgtcacagtcacacaaa

SEQ ID NO: 3054 - DNA, 252 bp, Glycine max
  unsure (1)..(252): unsure at all n locations
caattggnggctctcaaattgtgaaccgcacatatacccaccctgcttcccacgccacatcgatctccacgttctctctctttcttttttcttgttgaaactgtgagtctatgttatttgtggcggagcatgaactcctccaccaacacctcgaattctcagtcaatggctgcagcagccagtgatgggtctgggaagaaggtaagaaaaccttacaccataaccaagtccagggagagttggactgaggaa

SEQ ID NO: 3055 - DNA, 253 bp, Glycine max
cctttctctctcctctctttcctctctcttggaacaaacgacaagttatggtagtatttgtcattcatttcacaaaactggttcacctttggacccatggcttctaaaaactccacgttgttccagtctcgcttcttcctcttcggcttctattgctgggactgggagtttctcaccgctcttctcctctttagttcttcttcctaatcaaataaccttctccaccatacataaacctttttttttttgtctt

SEQ ID NO: 3056 - DNA, 275 bp, Glycine max
attctctctcctctctttcctctctcttggaacaaacgacaagttatggtagtatttgtcattcatttcacaaaactggttcacatttggacccatggcttctaaaaactccacgttgttccagtatcgcttcttcctcttcggcttctattgctgggactgggagtttctcaccgctcttctcctctttagttcttcttcctaatcaaataaccttctccaccatacataaaccttgttttttgagtcttttgtacttaaattcctcattacta

SEQ ID NO: 3057 - DNA, 280 bp, Glycine max
  unsure (1)..(280): unsure at all n locations
aacctttctctctcctctctttcctctctcttggaacaaacgacaagttatggtagtatttgtcattcatttcacaaaactggttcaccattggacccatggcttctaaaaactccacgttgttccagtctcgcttcttcctcttcggcttctattgctgggactgggagtttctcaccgctcttctcctctttagttcttcttcctaatcaaataaccttctccaccatacataaaccgtntntttttgtcttttgtacttaaatgtctcattactaca

SEQ ID NO: 3058 - DNA, 238 bp, Glycine max
gcacaacaacttctccagcttcgttcgtcaactcaacacttatgtaatctaattattcttctctatcaattcctttcttttctctttttacatttttctgatttttcttaattttgcttgacttgtagggatttagaaaagttgtacctgaccgctgggagttctcgaacgagtattttcgaagaggcgaaaagcgtcttctctgcgaaatccagcgacggaagatcctctccgcatc

SEQ ID NO: 3059 - DNA, 217 bp, Glycine max
ctttctattctctttttacatttatctgatttttcttaattttgcttgacttgtagggatttagaaaacgagtacctgaccgctgggagttctcgaacgagtattttcgaagaggcgaaaagcgtcttctctgcgacatccagcgacggaagatcctctccgcatctcctccgccggcgggagtaactgccaccgtggcggttccgtcgccgctgcc

SEQ ID NO: 3060 - DNA, 225 bp, Glycine max
ttaaagaaaggagccaagcgtgctgtaaatgggtctgctgtccctgtgatagaagattttcaggaagatgaaatgaaagaggctgataagttgataaaggaagaggccctgtatctttgtgcagcaatgggtcatgaagatgaacctcttgatgaatttattgaagcacacagaacctgtctcaatgatcttatgtactttcctacccgtaatgcatatggtctc

SEQ ID NO: 3061 - DNA, 240 bp, Glycine max
gagcaagctgacgagatgattagacgggagcttctaagtttactggagcatgacaatgctaagtatccacttgatgagaaagtgattaaggagaagaagaaaggagccaagcgtgctgtaaatgggtctgctgtccctgtgatagaagattttgaggaagatgaaatgaaagaggctgataagttgataaaggaagaggccctgtatctttgtgcagcaatgggtcatgaagatgaaccc

SEQ ID NO: 3062 - DNA, 226 bp, Glycine max
gcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggcctgctggcgttcactccc

SEQ ID NO: 3063 - DNA, 243 bp, Glycine max
tgggaaggtccccttgctgtgagaaagcacacacaaacaaaggtgcatggaccaaagaagaagatcatcgcctcatttcttacattagagctcacggtgaaggctgctgccgctctctccccaaagccgccggccttctccgttgcggcaagagctgtcgtctccgctggatcaactatctccgccctgacctcaagcgcggccaatttcaccctcgaagaagaccaactcatcatcaaactc

SEQ ID NO: 3064 - DNA, 260 bp, Glycine max
ggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccatagcctcgcttggcaaca

SEQ ID NO: 3065 - DNA, 249 bp, Glycine max
agccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggccttctccggtgcgg

SEQ ID NO: 3066 - DNA, 274 bp, Glycine max
gctgcaagcaatcctaattcctattctcctatccttttacataactctaaagttagagaaaatagagcaatttcacaacacaactcttataattgtgagttaagtatgggaaggtccccttgctgtgagaaagctcacacaacaaaggtgtctggactaaagaagaagatgacagactcatatcttatattcgagctcacggagaaggctgctggcgttcactccccaaagccgccggccttctccggtgcggcaagagctgccgtctccggtg

SEQ ID NO: 3067 - DNA, 270 bp, Glycine max
  unsure (1)..(270): unsure at all n locations
ccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttcaccctcgaagaagaccaactcatcatcanactccatagcctccttggcaacaagtggtctctaattgctgga

SEQ ID NO: 3068 - DNA, 181 bp, Glycine max
cggctgcgagaagacgacagaaggggggagagagagatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgtt

SEQ ID NO: 3069 - DNA, 272 bp, Glycine max
acggctgcgagaagacgacagaaggggggagagagagatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttcaccctcgaagaagaccaactcatca

SEQ ID NO: 3070 - DNA, 177 bp, Glycine max
tctcgagccgattcggctcgagtacggctgcgagaagacgacagaaatggggagagagagaacggaaggtccccttgctgtgagaaagcacacacaaacaaaggtgcatggaccaaagaagaagatcatcgcctcatttcttacattagagctcacggtgaaggctgctggcgctct

SEQ ID NO: 3071 - DNA, 258 bp, Glycine max
ataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctcc

SEQ ID NO: 3072 - DNA, 222 bp, Glycine max
ctcgagccgattctcctatccttttacataactctaaagtaagaaaaaatagagcaatactcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagcc

SEQ ID NO: 3073 - DNA, 219 bp, Glycine max
gtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctaaagcgcgggaatttctccctcgaagaggacca

SEQ ID NO: 3074 - DNA, 406 bp, Glycine max
tgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacatgcctctcaacgactcttcccatcaaga

SEQ ID NO: 3075 - DNA, 352 bp, Glycine max
tgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgag

SEQ ID NO: 3076 - DNA, 255 bp, Glycine max
aagaaagatccgtaaattaacattctctccctcccttcgctataatagcaagcttttcaagcatatttctggggtttggtcccttttccttgtttggggttttcttgggaaaaaagaagtaattaggtataataatagtataactaaagcaaaaaaaaagacagtaatatggcaaggggtagggttcagctgaagaggatagagaacaagatcaatcggcaggtaactttctccaaaaggagagctgggttactc

SEQ ID NO: 3077 - DNA, 289 bp, Glycine max
ctcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcaccccgacgaggaagtgaacacattagcatcggctcatcctaagaaacgtgcggggcgtcgaatttttaaggagacaaggcatcccgtgtacagaggagtgcggcggaggaacaacaacaagtgggtctg

SEQ ID NO: 3078 - DNA, 297 bp, Glycine max
  unsure (1)..(297): unsure at all n locations
gcgcaaaccaaaccaacacaaacaaaaacatctctcagcaaatgantattctcggacaatcatccaccaatcaaacaacgggcagctactcttgttcgtcgccggagactgcaaactcctctaaccttccgaccactccgaaagctgttcactccgacgaggaagtgaacacattagcatcggctcatcctaagaacgtgcggggcgtcgatttttaaggagacaaggcatcccgtgtacagaggagtgcggcggaggaacaacaacaagtgggtctgcgaggttcgtgttcccaac

SEQ ID NO: 3079 - DNA, 287 bp, Glycine max
aaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttaccaacgacaagtccac

SEQ ID NO: 3080 - DNA, 307 bp, Glycine max
  unsure (1)..(307): unsure at all n locations
cgcaataactcagccacagccacaacacacaaacacaaacccttcgttcctctctcgttcccttcttcaattcgatcaaacacagaatagtacttttttattatgatggccgtggcccgaaaggaaatggaccggatcaagggcccgtggagcccggaggaggacgaggctcttcagaagctcgtggagcggcatgggcccagaaactggtccctcatcagcaggtccattccgggccggtctgggaaatcgtgcaggctccgatggtgcaacagctgtcgccacngtcgagcaccgggcttcngcc

SEQ ID NO: 3081 - DNA, 263 bp, Glycine max
cgaaaggacatggaccggatcaagggcccgtggagcccggaggaggacgaggcccttcagaagcttgtggagcggcacgggcccagaaactggtcgctcatcagcaggtccattccgggcggtctgggaagtcatgcaggcttcggtggtgcaaccagctgtcgccccaggtcgagcaccgggccttcacaccggaagaggacgagaccattattcgggcccatgcccggtttggtaacaagtgggccaccattgcgcgcctc

SEQ ID NO: 3082 - DNA, 266 bp, Glycine max
gccacagccacaacacacaaacacaaacccttcgttcctctctcgttcccttcttcaattcgatcaaacacagaatagtacttttttattatgatggccgtggcccgaaaggaaatggaccggatcaagggcccgtggagcccggaggaggacgaggctcttcagaagctcgtggagcggcatgggcccagaaactggtccctcatcagcaggtccattccgggccggtctgggaaatcgtgcaggctccgatggtgcaccagctg

SEQ ID NO: 3083 - DNA, 256 bp, Glycine max
gaatagtacttttttattatgatggccgtggcccgaaaggaaatggaccggatcaagggcccgtggagcccggaggaggacgaggctcttcagaagctcgtggagcggcatgggcccagaaactggtccctcatcagcaggtccattccgggccggtctgggaaatcgtgcaggctccgatggtgcaaccagctgtcgccacaggtcgagcaccgggccttcacgccggaagaggacgagaccataattagggccc

SEQ ID NO: 3084 - DNA, 248 bp, Glycine max
gcaataactcagccacagccacaacacacaaacacaaacccttcgttcctctctcgttcccttcttcaattcgatcaaacacagaatagtacttttttattatgatggccgtggcccgaaaggaaatggaccggatcagggcccgtggagcccggaggaggacgaggctcttcagaagctcgtggagcggcatgggcccagaaactggtccctcatcagcaggtccattccgggccggtctgggaaat

SEQ ID NO: 3085 - DNA, 261 bp, Glycine max
  unsure (1)..(261): unsure at all n locations
gcaataactcagccacagccacaacacacaaacacaaacnccttcgttcctctctcgttcccttcttcaattcgatcaaacacagaatagtacttttttattatgatggccgtggcccgaaaggaaatggaccggatcaagggcccgtggagcccggaggaggacgaggctcttcagaagctcgtggagcggcatgggcccagaaactggtccctcatcagcaggtccattccgggccggtctgggaaatcgtgcaggcgc

SEQ ID NO: 3086 - DNA, 260 bp, Glycine max
ctcagccacagccacaacacacaaacacaaacccttcgttcctctctcgttcccttcttcaattcgatcaaacacagaatagtacttttttattatgatggccgtggcccgaaaggaaatggaccggatcaagggcccgtggagcccggaggaggacgaggctcttcagaagctcgtggagcggcatgggcccagaaactggtccctcatcagcaggtccattccgggccggtctgggaaatcgtgcaggctccgatggt

SEQ ID NO: 3087 - DNA, 261 bp, Glycine max
  unsure (1)..(261): unsure at all n locations
ctcagccacagccacaacacacaaacacaaacccttcgttcctctctcgttcccttcttcaattcgatcaaacacagaatagtacttttttattatgatggccgtggcccgaaaggaaatggaccggatcaagggcccgtggagcccggaggaggacgaggctcttcagaagctcgtaaaacagnatgggcccagaaactggtccctcatcagcaggtccattccggggccggtcttgggaatcgtgcaggctccgatggt

SEQ ID NO: 3088 - DNA, 232 bp, Glycine max
gctctggattctcactcacctgaacggatccttcttcttccttatcgcgaaatccatacttcaaaccctaatcgcgactgcggtttatgatttgtgacacaacacaaagttgacgaaggtggtttttcagcatttgtattctagtattcttctacataagttgaagcgaaaatgaggattatgataaagggcggtgtttggaaaaacaccgaagatgaaatcctaaaagcag

SEQ ID NO: 3089 - DNA, 258 bp, Glycine max
gctcgctctggattctcactcacctgaacggatccttcttcttccttatcgcgaaatccatacttcaaaccctaatcgcgactgcggtttatgatttgtgacacaacacaaagttgacgaaggtggtttttcagcatttgtattctagtattcttctacataagttgaagcgaaaatgaggattatgataaagggcggtgtttggaaaaacaccgaagatgaaatcctaaaagcagctgttatgaaatatggcaagaa

SEQ ID NO: 3090 - DNA, 241 bp, Glycine max
gcaaacacttccttgagggcacaaaagattccattgtttgcttctttcagattaatttttttgtcagttcagatcttcaagaagaagaatccagagaagctatatatacatcatcgttgttctttgccaagacaaagaagaaaaatggtgagggggaaaactcatgaagcgcatagaaaatgagacgagtaggcaagtaacgttctccaagagaaggaacgggttgctcaagaaggccttt

SEQ ID NO: 3091 - DNA, 257 bp, Glycine max
gtgtgcattcttgtttaactcctctttgttcctcagacatcccagaagggaaccaaaaataaaaaataaaaaaataaacacaatcaataaaggggagaaaacaaacatgtcattcacaggaactcttgataaatgcacagcatgtgacaagactgtctatgtggttgacttgttaactcttgaaggaattccttaccataaaaactgcttcaagtgcagtcactgcaagggatgtcttacgatgtgcacatactcct

SEQ ID NO: 3092 - DNA, 269 bp, Glycine max
cttttgtctgaggtgtgtgcattcttgtttaactcctctttgttcctcagacatcccagaagggaaccaaaaataaaaaataaaaaaataaacacaatcaataaaggggagaaaacaaacatgtcattcacaggaactcttgataaatgcacagcatgtgacaagactgtctatgtggttgacttgttaactcttgaaggaattccttaccataaaaactgcttcaagtgcagtcactgcaagggatgtcttacgatgtgcacatactc

SEQ ID NO: 3093 - DNA, 257 bp, Glycine max
ggacatactctgagcgtgagatagagaaggggaagaaagagagagagtgatgggaaggggaagagtggagttgaagagaattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttaagcatgctcaaaacgctggaggggta

SEQ ID NO: 3094 - DNA, 267 bp, Glycine max
ggggaagagtagagagagagagagagagatgggaaggggaagagtggagttgaagaggattgagaacaagatcaacaggcaagtgacctttgcaaaacgaaggaacgggcttttgaagaaagcttatgagctttccgttctgtgtgatgccgaggttgctctcatcatcttctccaatagaggaaagcagtacgagttttgcagcggttcaagcatgctcaaaacgctggagaggtaccagaaatgcaactatggagcgcctgagga

SEQ ID NO: 3095 - DNA, 263 bp, Glycine max
  unsure (1)..(263): unsure at all n locations
cggctgcgagaagacgacagaaggggctacatatatatattatagagattttatacattctaaattttgtgagtgtggacatactctgagcgtgagaaagagaaggggaagaaagagagagagtgatgggaaggggaagagtggagttgaagagaattgagaacaagatcaacaggcaagtgacctttgcaaaacgaaggaacgggcttntgaagaaagcttatgagctttccgttctttgtgatgccgcaggtgctctcatc

SEQ ID NO: 3096 - DNA, 249 bp, Glycine max
  unsure (1)..(249): unsure at all n locations
ggagaaggggaagagtagagagagaacagagagagatgggaaacggaagagtggagttgaagacgattgagaacaagatcaacaggcaagtnacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgttggagaggtaccaga

SEQ ID NO: 3097 - DNA, 265 bp, Glycine max
gctcgaggccacgaaaatattcatcacacagggttttggtttattattccaatttttggttttcccttttgttggatattagagtgtgtaagaaagagaagagagagtaatgggaaggggaagagtggagttgaagagaattgagaacaagatcaacaggcaagtgacctttgcaaaacgaaggaacgggcttttgaagaaagcttacgagcttaccgttctttatgataccgaggttgctctcatcatcttctccaatagaaga

SEQ ID NO: 3098 - DNA, 285 bp, Glycine max
tcgcgagcgagccacgagaatattcatcacacagggttttggtttattattccaatttttggttttcccttttgttggatattagagtgtgtaagaaagagaagagagagaaatgggaaggggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctg

SEQ ID NO: 3099 - DNA, 279 bp, Glycine max
cagggttttggtttattattccaatttttggttttcccttttgttggatattagagtgtgtaagaaagagaagagagagaaatgggaaggggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctgcagcagttcaagcatgctcaaaacg

SEQ ID NO: 3100 - DNA, 170 bp, Glycine max
ctctgagcgtgatatagagaaggggaagaaagagagagagtgatatgaaggggaagagtggagttgaagagaattgagaacaagatcaacaggcaagtgacctttgcaaaacgaaggaacgggcttttgaagaaagcttatgagctttccgttctttgtgatgccgaggt

SEQ ID NO: 3101 - DNA, 265 bp, Glycine max
catactctgagcgtgagaaagagaaggggaagaaagagagagagtgatgggaaggggaagagtggagttgaagagaattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgctggagaggtaccagaaatgc

SEQ ID NO: 3102 - DNA, 255 bp, Glycine max
gattttatacattctaaattttgtgagtgtggacatactctgagcgtgagaaagagaaggggaagaaagagagagagtgatgggaaggggaagagtggagttgaagagaattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcag

SEQ ID NO: 3103 - DNA, 382 bp, Glycine max
acccacgcgtccatacggctgcgagaagacgacagaaggggacgcagcgagcgagccacgaaaatattcatcacacagggttttggtttattattccaatttttggttttcccttttgttggatattagagtgtgtaagaaagagaagagagagaaatgggaaggggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctgcaggagttcaagcatgctcaaaacgctagagaggtaccagaaatgtaactatg

SEQ ID NO: 3104 - DNA, 314 bp, Glycine max
accacgcgtcagtaaggctgcgagaagacgacagaaggggagagagagagagagagagatgggaaggggaagagtggagttgaagaggattgagaacaagatcaacaggcaagtgacctttgcaaaacgaaggaacgggcttttgaagaaagcttatgagctttccgttctttgtgatgccgaggttgctctcatcatcttctccaatagaggaaagcagtacgagttttgcagcggttcaagcatgctcaaaacgctggagaggtaccagaaatgcaactatggagcgcctgaggacaatgtggcaacaaatg

SEQ ID NO: 3105 - DNA, 249 bp, Glycine max
cggctcgagccgggccttcacggccgaagaggacgacaccataatccgggcccatgcccgcttcggcaacaagtgggccaccatagcccgcctcctccacggcagaaccgacaacgctatcaaaaaccactggaactccaccttgaagcgcaagtgctcttcaaccatgatcgacgacaacacccaaccgctgaaaagatccgtgagtgccggcgcggctattccagtctctactggactctacatgaa

SEQ ID NO: 3106 - DNA, 152 bp, Glycine max
ccatagcccgcctcctccacggcagaactgacaacgccatcaaaaaccactggaactccaccttgaagcgcaagtgcacttcaaccatgattgacgacgacaacactcccccgctcaaaagatccctcagtgccggcgctgctattccagtc

SEQ ID NO: 3107 - DNA, 256 bp, Glycine max
tgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaacagaaacaatccaagagtgcgtgtctgagtacatcagcttcatcacaggtgaggcgaacgagcgttgccagagggagca

SEQ ID NO: 3108 - DNA, 243 bp, Glycine max
caccgctgggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacagg

SEQ ID NO: 3109 - DNA, 359 bp, Glycine max
  unsure (1)..(359): unsure at all n locations
acagctgcgagaagacgacagaagggggcctacttcatctctcttataatcacacacacacctaccttaatagctatggaaactggaggctttcacggctaccgcaagctccccaacaccaccgctgggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcanaaatctcggacgatgcanaagaaacaaccaaagagtgcgtgtctgagtacatcaccttcatcac

SEQ ID NO: 3110 - DNA, 400 bp, Glycine max
cccacgcgtccgtacggctgcgagaagacgatagaagggtacagctgcgagaagacgacagaagggggaggctttcacgggtaccgcaagctccccaacaccaccgctgggttgaaactgtcagtgtcagacatgaacatgaagcagcacgtaacatcatcagatcacagtgcaatcgcatgagaggagaacgaatgcacggtgagggagcaagacaggttcatgccaatcgccaacgtgattacgatcatgcacaagattctccctccacacgcaaaaatctcggacgatgcagatgaaacaatccaagagtgcgtgtctgagtacatcagcttcatcacaggtgaggcgaacgagcgttgccagatggagcagcggaagaccataaccgcagaggacg

SEQ ID NO: 3111 - DNA, 274 bp, Glycine max
atagtagaaggtcggggatagtaaagagagaaatccgaatagaaaaagaagctagctagggtttcggcgcgaagaagaatggggaagaagaaggtggagataaagcgaatcgagaacaaaagcactcggcagataacattctccaagaggcgcaatggattgatgaagaaagctcgcgagctatccattctctgcgatgcgaaggtggcgctgctcatcttctccagcaccggaaagctctacgagctctgcaacggtgacagtttggccgagg

SEQ ID NO: 3112 - DNA, 281 bp, Glycine max
gagaaaaccgaatagaaaagaaggtagctagctagggttttggcgcgaagaagaatggggaagaagaagctggagataaagcgaatcgagaacaaaagcaatcggcagataacattctccaagaggcgcaaaggattgatgaagaaagctcgcgagttatccattctctgcgatgcgaagttggcgctgctcatcttctccagcaccggcaagctctacgagctttgcaacggtgacagtttgccgaggtcgtgcagcgatattgggataacttaggagcg

SEQ ID NO: 3113 - DNA, 270 bp, Glycine max
gaagacgacagaagggggtgggacaaagagagaaaaccgaatagaaaagaaggtagctagctagggttttggcgcgaagaagaatggggaagaagaagctggagataaagcgaatcgagaacaaaagcaatcggcagataacattctccaagaggcgcaaaggattgatgaagaaagcccgcgagttatccattctctgcgatgcgaagttggcgctgctcatcttctccagcaccggcaagctctacgagctttgcaacggtgacattt

SEQ ID NO: 3114 - DNA, 254 bp, Glycine max
gtacagagagagagagagagagataatagtagaaggtcggggatagtaaagagagaaatccgaatagaaaaagaagctagctagggtttcggcgcgaagaagaatggggaagaagaaggtggagataaagcgaatcgagaacaaaagcactcggcagataacattctccaagaggcgcaatggattgatgaagaaagctcgcgagctatccattctctgcgatgcgaaggtggcgctgctcatcttctccagca

SEQ ID NO: 3115 - DNA, 266 bp, Glycine max
tacggctgcgagaagacgacagaagggggcctcctacatttcaccaccccctttatccttatctcctctcttcttcatttgttctgctcttcccctctatttaaagctcacacaaagggatcatataccttggttgcactttggtaaggtgagagaataggaaaaagggaaatatggcatttgcaggaacaactcagaagtgcatggcttgtgacaaaacagtttatctggttgataagttgacaagagttaccgagtgtaccaat

SEQ ID NO: 3116 - DNA, 276 bp, Glycine max
  unsure (1)..(276): unsure at all n locations
atggattatgatggtatgagaaaaccttccaaaaacttatttcactctcgcttcttcctttttgggttctattgctgggattgggagttcttgaccgctctcctcctttttagttcttccccttaatcttctttcttcacaattttatttccttccttattagacgtattagatcagattgaacaaaagggnnnnnnnnnnnnnnnnnnnnggggaataataganataagaaaagattagtgaggttgaaatgtcgcaacgatcggtgccggcgcc

SEQ ID NO: 3117 - DNA, 155 bp, Glycine max
cttttgtgtggggaattatggtaattgattttgagggtttgactactcatggattatgatggtatgagaaaaccttccaaaaacttatttcactctcgcttcttcctttttgggttctattgctgggattgggagttctgaccgctctcctcctt

SEQ ID NO: 3118 - DNA, 256 bp, Glycine max
  unsure (1)..(256): unsure at all n locations
ggaatnatggtaattgattttgagggtttgantactnatggattatgatggtatgagaanaccntccaaaaacttatttcactctcgcttcttccnttnngggttctattgctgggattgggagttcttgaccgcnctcctccttnntagttcttccccttaatcttctntcttcacaantttnatntcctnccttattagacgtattagatcagattgaacaaaagggtttttctntctntctntcttggggaat

SEQ ID NO: 3119 - DNA, 262 bp, Glycine max
atccttttgtgtggggaattatggtaattgattttgagggtttgactactcatggattatgatggtatgagaaaaccttccaaaaacttatttcactctcgcttcttcctttttgggttctattgctgggattgggagttcttgaccgctctcctcctttttagttcttccccttaatcttctttcttcacaatttttatttccttccttattagacgtattagatcagattgaacaaaagggtttttctttctttctttct

SEQ ID NO: 3120 - DNA, 240 bp, Glycine max
tggtaattgatttagagggtttgactactcatggattatgatggtatgagaaaaccttccaaaaacttatttcactctcgcttcttcctttttgggttctattgctgggattgggagttcttgaccgctttcctcctttttagttcttccccttaatcttctttcttcacaatttttatttccttccttattagacgtattagatcagattgaacaaaagggtttttctttctttctttc

SEQ ID NO: 3121 - DNA, 271 bp, Glycine max
attcactgtactttatccttttgtgtggggaattatggtaattgattttgagggtttgactactcatggattatgatggtatgagacaaccttccaaaaacttatttcactctcgcttcttcctttttgggttctattgctgggattgggagttcttgaccgctctcctcctttttagttcttccccttaatcttctttcttcacaatttttatttccttccttattagacgtattagatcagattgaacaacagggtttttctttctttc

SEQ ID NO: 3122 - DNA, 262 bp, Glycine max
cttttgtgtggggaattatggtaattgattttgagggtttgaatactcatggattatgatggtatgagaaaaccttccaaaaacttatttcactctcgcttcttcctttttgggttctattgctgggattgggagttcttgaccgctctcctcctttttagttcttccccttaatcttctttcttcacaatttttatttccttccttattagacgtattagatcagattgaacaaaagggtttttctttctttctttcttgg

SEQ ID NO: 3123 - DNA, 185 bp, Glycine max
atttaattcactgtactttatccttttgtgtggggaattatggtaattgattttgagggtttgactactcatggattatgatggtatgagaaaaccttccaaaaacttatttcactctcgcttctcccttttgggttctattgctgggattgggagttcttgaccgctctcctcctttttagttc

SEQ ID NO: 3124 - DNA, 236 bp, Glycine max
cttttgtgtggggaattatggtaattgattttgagggtttgactactcatggattatgatggtatgagaaaaccttccaaaaacttatttcactctcgcttcttcctttttgggttctattgctggattgggagttcttgaccgctctcctcctttttagttcttccccttaatcttctttcttcacaatttttatttccttccttattagacgtattagatcagattgaacaaaa

SEQ ID NO: 3125 - DNA, 201 bp, Glycine max
cttttgtgtggggaattatggtaattgattttgagggtttgactactcatggattatgatggtatgagaaaaccttccaaaaacttatttcactctcgcttcttcctttttgggttctattgctgggattgggagttcttgaccgctctcctccttttaagttcttcccctaaatcttctttctccaaatttttaaccccc

SEQ ID NO: 3126 - DNA, 283 bp, Glycine max
actgtactttatccttttgtgtggggaattatggtaattgattttgagggtttgactactcatggattatgatggtatgagaaaaccttccaaaaacttatttcactctcgcttcttcctttttgggttctattgctgggattgggagttcttgaccgctctcctcctttttagttcttccccttaatcttctttcttcacaatttttatttccttccttattagacgtattagatcagattgaacaaaagggtttttctttctttctttcttggggaataat

SEQ ID NO: 3127 - DNA, 283 bp, Glycine max
attcggctcgagtccttttgtgtggggcaattatggtaattgattttgagggtttgactactcatggattatgatggtatgagaaaaccttccaaaaacttatttcactctcgcttcttcctttatgggttctattgctgggattgggagttcttgaccgctctcctcctttttagttcttccccttaatcttcttcttcacaattttgatttccttccttattagacgtattagatcagattgaacaaaagggtttttcattctttctttcttggggaataa

SEQ ID NO: 3128 - DNA, 241 bp, Glycine max
ttcagatttttccggtgtcactcctaagaaaaaggagattcagactccaaacccaatgctgactccttctgcaactcctggagctgcaggtctcactcctagaattggcatgacaccaacagagatggtttttcttttagcatgacaccaaagggaactcctcttagggatgagctacatattaatgaggacatgaatatgcatgacagcactaaacttgagctacagagacaggctgata

SEQ ID NO: 3129 - DNA, 263 bp, Glycine max
aaacaagagagagctagcagtgcaagctttcaacatccaaaacaacagagagtttttggctttagaagctgaaggaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggat

SEQ ID NO: 3130 - DNA, 286 bp, Glycine max
cttagaagttgaaggagtagtctaagtcatcaaaatggggagagctccatgctgcgagaaaatggggttgaagagagggccatggactccagaagaagatcaaattctcatcaattatatcaacacttatgaccatgctaattggcgtgcattgcccaaactagctgggctgttaaggtgtggaaagagttgcagactccggtggataaattatctgagaccggacatcaaacggggcaactttaccagagaagaagaggacaccataatcagtttgcatgaaatg

SEQ ID NO: 3131 - DNA, 249 bp, Glycine max
ccgagtttttggctttagaagctgaaggcatatagttatcacaatggggagagctccatgctgtgagacaatggggttgaagagagggccatggactccagaagaagatcaaattctcatcagttacatcaacacttatggccatgctaattggcgtgcactgcccaaactagctgggctattaaggtgtggaaagacttgtagactccggtggataaattatctgcacaccggacatcaaacggggca

SEQ ID NO: 3132 - DNA, 267 bp, Glycine max
aacaagagagagctagcagtgcaagctttcaacatccaaaacaacagagagtttttggctttagaagctgaaggaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaatt

SEQ ID NO: 3133 - DNA, 425 bp, Glycine max
  unsure (1)..(425): unsure at all n locations
cgtcagcccacgcgtccgtactgctgcgagaagacgaccgaagggggaatcaactttggtgtatatataaaaacaagagagagctagcagtgcacgctttcaacatccaaaacaacagagagtttttggctttagaagctgaacgaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaattatctgagaccggacatcanacgggacaacttttacagagaagaagaggacactataatcagtttgcatgaaatgttgggaaacagat

SEQ ID NO: 3134 - DNA, 253 bp, Glycine max
gcctgacgtcacttataatgacattggaggatgtaatatacagtaacaggtaatccgtgaggctgtggagctaccccttacacatcatgaactatacaaacaaattggtattgatcctccccgtggtgtattactgtatggaccccctggcactggcaaaacaatgcttgcgaaagctgttgcgaatcataccactgctgctttcatcagggatgtgggatctgagtttgtgcagaagtatcttggtgatttt

SEQ ID NO: 3135 - DNA, 240 bp, Glycine max
  unsure (1)..(240): unsure at all n locations
caganacaggaaatccgtgaggctgtggagctaccccttacacatcatgaactatacaaacaaattggtattgatcctcctcgtggtgttttactgtatggaccccctggcactggcaaaacaatgcttgccaaagctgttgctaatcataccactgccgccttcatcagggttgtaggatctgagtttgtgcaaaagtatctggtgagggtccacgaatggttcgtgatgtatttcgtc

SEQ ID NO: 3136 - DNA, 294 bp, Glycine max
  unsure (1)..(294): unsure at all n locations
aaacattgacttganactgatcagatcaattaacacacagagaganagagagagagnagcatagcaaacatgggaagagctccttgttgtgacaaagctaatgtcaagagaggtccatggtcacctgaagaagacaccaaactcaaatcttatattgaagagcatggaactggtggcaactggatagccttgcctcagaaaataggcctcaagaggtgtgggaaaagctgtcgtctcaggtggctgaattatcttcgtccaaacatcaaacacggaggtttctcagaagaagaa

SEQ ID NO: 3137 - DNA, 164 bp, Glycine max
taaacattgacttgaaactgatcagatcaattaacacacagagagagagagagagagaagcatagcaaacatgggaagagctccttgttgtgacaaagctaatgtcaagagaggtccatggtcacctgaagaagacaccaaactcaaatcttatattgaagagc

SEQ ID NO: 3138 - DNA, 280 bp, Glycine max
ctttacttgaaactcagaccaactgacacagagagagagagaagcatcagcagacatgggaagagctccttgctgtgacaaagccaacgtgaagaaaggtccatggtcacctgaagaagatgccaaactcaagtcttatattgagcagcatggcactggtggcaactggattgccttgccccagaaaataggccttaagagatgtgggaaaagctgtcgtcttagatggctgaattatcttcgcccatacatcaaacatgggggtttctcagaagaagaa

SEQ ID NO: 3139 - DNA, 235 bp, Glycine max
cgcctctgagggagtggggtccactcacacaggaagccaccgcgatttcgatctgaacctcccggcttttccggacttttcaacaaggttcttcgttgatgacgaggttaccagtcctcatccatccaagaaatcccgtctcaatttgaccatacccaagattgaaatccctcaatactgatgatccatagatccaaaaaatattcagtgtttttttcttctttcttttttaaag

SEQ ID NO: 3140 - DNA, 258 bp, Glycine max
agggagtggggtccactcacacaggaagccaccgcgatttcgatctcaacctcccggcttttccggacttctcagcaaggttcttcgtcgatgacgaggttaccagtcctcatccatccaagaagtcccgtttcaatttgaccatacccaagattgaaatccctcaatactgatccatagatccaaaaaaattattcagtgtttttttatatatttttttaagttatttgggattaatttgttcttgtacatatatag

SEQ ID NO: 3141 - DNA, 238 bp, Glycine max
gtcggaatcctgtctttcgttgataaggatcagttggagcctggttgtgctattttgatgcataataaggttctttctgttgttgggcttcttcaagatgaagttgatccaatggtctctgtcatgaaggttgagaaggctcctctggaatcttatgctgacattggtggtttagatgcccaaatacaggaaattaaagaagcagttgagctacccctgacgcatcctgaactatatg

SEQ ID NO: 3142 - DNA, 259 bp, Glycine max
cagaaaggtccggaggcggcggcgcggttgccgacagtgactccggtgacgaagtgcaaactgcggcttctgaagctggagcggatcaaggactaccttctgatggaggaggagttcgtggcgaatcaggagcgactcaagccgcaggaggagaaggccgaggaagacagatccaaggtcgatgatctccgaggctctcccatgagcgtcggaaacctcgaagagctcatcgacgagaatcacgctattgtctcctcct

SEQ ID NO: 3143 - DNA, 242 bp, Glycine max
gtcggaatcctgtctttcgttgatctggatcagttggagcctggttgtgctattttgatgcataataaggttctttctgttgttgggcttcttcaagatgaagttgatccaatggtctctgcatgaaggttgagaaggctcctctggaatcttatgctgacattggtggtttagatgcccaaatacaggagattaaagaagcagttgagctacccctgttgcatcctgaactatatgaagac

SEQ ID NO: 3144 - DNA, 244 bp, Glycine max
tgaagctggagcggatcaaggactaccttcttctggaggaggagttcgtggcgaatcaggagcgactcaagccgcagaggagaaggccgaggaagacagatccaaggtcgatgatctccgaggctctcccatgagcgtcggaaacctcgaagagctcatcgacgagaatcacgctattgtctcctcctccgttgggcctgagtactatgtcggaatcctgtctttcgttgataaggatcagttg

SEQ ID NO: 3145 - DNA, 279 bp, Glycine max
  unsure (1)..(279): unsure at all n locations
gaagttcgagccgtcngctccgccgggcncgcgtggggcggaaacagcggaagcagaaaggtccggacccggcggcgcggttnccgacagtgactccggtgacgaagtgcaaactgcggnttctgaagctggagcggatcaaggactaccttctgatggaggaggagntcgtgggcgaatcaggagcnactcaagccgcagaggagaaggccgangaagacagatcccaagttcgatgatctccgaggctctcccatgagcgtcggaaacctcgaagac

SEQ ID NO: 3146 - DNA, 275 bp, Glycine max
ggactaccttctgatggaggaggagttcgtggcgaatcaggagcaactcaagccgcaggaggagaaggccgaggaagacagatccaaggtcgatgatctccgaggctctcccatgagcgtcggaaacctcgaagagctcatcgacgagaatcacgctattgtcacctcctccgttgggcctgagtactatgtcggaatcctgtcattcgttgataaggatcagtttttttattggttgtgctattttgatgcataataaggttctttctgttgtt

SEQ ID NO: 3147 - DNA, 257 bp, Glycine max
cgcaggaggagaaggccgaggaagacagatccaaggtcgacgatctccgaggctctcccatgagcgtcggaaatctcgaagagctcatcgacgaaaatcacgctattgtttcctcctccgtcgggcctgagtattacgtcggaatcttgtctttcgtcgataaggatcagttagagcctggttgtgctattttgatgcataataaggttctttctgttgttgggcttcttcaagatgaagttgatccaatggtctct

SEQ ID NO: 3148 - DNA, 413 bp, Glycine max
gcagggcgaccggaagccggacggcggcgacaagaaggagaagaagttcgagccggcggcgccgccagcacgcgtggggcggaaacagcggaagcagaagggcccggaggcggcggcgcggctgccgacggtgactccggtgacgaagtgcaagctgcggctgctgaagctggagcggatcaaggactacctactgatggaggaagagttcgtggcgaatcaggagcgactcaagccgcaggaggagaaggccgaggaagacagatccaaggtcgacgatctccgaggctctcccatgagcgtcggaaatctcgaagagctcatcgacgaaaatcacgctattgtttcctcctccgtcgggcctgagtattacgtcggaatcttgtctttcgtcgataaggatcaattggagc

SEQ ID NO: 3149 - DNA, 315 bp, Glycine max
  unsure (1)..(315): unsure at all n locations
atcaggagcgactcaagccgcaggatgagaaggccgaggaagacagatccaaggtcgatgatctccgaggctctcccatgagcgtcggaaacctcgaagagctcatcgacgagaatcacgctattgtctcctnctccgttgggcctgagtactatgtcggaatcctgtctttcgttgataaggatcagttggagcctggttgtgctattttgatgcataataaggttctttctggtgttgggcttcttcaagatgaagttgatccaatggtctctgtcatgaaagttgagaaggcctctctggaatcttatgctg

SEQ ID NO: 3150 - DNA, 255 bp, Glycine max
ctcctatcacataataacaaccttaaccttaaccttaaaccccccaattttcatgtctcggatcccgtgattcggatccccaacaaaaaaagaaacctcgtatttgttattttcgtcggatccggttgggaacgctcatgacgcggcgttgctcgcattgcagccacaatgggcacaactccagaacctgccctaaccgcggggttaagctcttcggggtccgattaaccgacgggtcgatccggaagagcgcca

SEQ ID NO: 3151 - DNA, 267 bp, Glycine max
ataataacaaccttaaccttaaccttaaaccccccaattttcatgtctcggatcccgtgattcggatccccaacaaaaaaagaaacctcgtatttgttattttcgtcggatccggttgggaacgctcatgacgcggcgttgctcgcattgcagccacaatgggcacaactccagaacctgcactaaccgcggggttaagctcttcggggtccgattaaccgacgggtcgatccggaagagcgccagcatgggcaacctagcccacta

SEQ ID NO: 3152 - DNA, 276 bp, Glycine max
ctcgagccgcttcccttctcttcacatctcatctaaatctctatctctgtctctgtctctagtccgctcagctttcactccaaaccctaaccaaccgctctctttcgcctatcccggaaaccttccgaatcgtttaattgacgctacgccgtggaatcttggcggaacaaatccacgatggcggcctccaccaccagccaggtctacatccaggtaatcgacgatgtcatgaacaaggtccgcgacgagtttgtcaacaacggtggtcccggcgac

SEQ ID NO: 3153 - DNA, 287 bp, Glycine max
attgctgtctcaggtggtccaagattgctgccaggttacccggaagaacagacaatgagattaaaaatcattggaacaaccatattcaaggaaaaaatcctttaagataggtattgatcccgttactcatgagcctctcaaaaaacaagctgcagcatcttctcaggatagttcatcctcccctgcagagcatttgccgcaacctggcaataaccttgatgatcaggtcaaagaaactgaagggattcttctcaactcagaggagattcaagttcatcacaagctga

SEQ ID NO: 3154 - DNA, 233 bp, Glycine max
ctctttgtgtgtctctttctctatttctgagtctcagtgttaggggggttattcattattcataataacttggctttatagcattttcccttttgatataaaatgggaaggcaaccttgttgtgacaaagttggttgaagaaggggccatggactgcagaggaggataagaagctcataagcttcatcctcactaatggccaatgttgctggagagctgtccctaagctagca

SEQ ID NO: 3155 - DNA, 270 bp, Glycine max
attcctcttggctcccttaaactctctttctctctttgtgtgtctctttctctatttctgagtctcagtgttaggggggttattcattattcataataacttggctttatagcattttcccttttgatataaaatgggaaggcaaccttgttgtgacaaagttgggttgaagaaggggccatggactgcagaggaggataagaagctcataagcttcatcctcactaatggccaatgttgctggagagctgtccctaagctagcagggct

SEQ ID NO: 3156 - DNA, 263 bp, Glycine max
ccatttccagaattagtagcactagtgctctcttttgtttcgaaaaaaatggttcaacaggaagtgcgtaaaggtccttggacagaacaggaagacttctcattggtgtcctttgttggattgtttggagaccgtagatgggactttatagctaaggtttgaatagaacaggtaagagttgcagattaaggtgggttaattacctacatcctggcctcaagcgtggaaagatgaccccccaggaagaacgccttgtcttggaa

SEQ ID NO: 3157 - DNA, 261 bp, Glycine max
  unsure (1)..(261): unsure at all n locations
gacttaccccttgctaccaacactgagcttaaccgagcttcgcaaagatgaatcgggaaaagttaatnannatggccggttacggttagaactggaggaaagggtactgtgagangaaagaagaaggctgtccacaagacaacaaccanagatgacaanaggcttcagagcacccngaagagaataggggtgaatgccatccctgctattgaagaggtcaatatctttaangatgacgtagtatcnagtttctaantccca

SEQ ID NO: 3158 - DNA, 265 bp, Glycine max
  unsure (1)..(265): unsure at all n locations
gngagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggcggtgcaatatctttaaggatgacgtattatccatttctcaaatcccaaagttcaagcatccatgctgnctcannantgggttg

SEQ ID NO: 3159 - DNA, 249 bp, Glycine max
  unsure (1)..(249): unsure at all n locations
cttaaccgagcttcgcaaagatnaatcgggaaaagttaatgaagatggccggttcggttagaactggaggaaagggtactgtgagaaganagaagaaggctntccacaagacaacaaccacagatgacaaaaggcttcagagcaccctgaagagaataggggtgaatgccatccctgctattgaagaggtcaatatctttaaggatgacgtagttatccagtttctaaatcccanagttcaagcatcca

SEQ ID NO: 3160 - DNA, 255 bp, Glycine max
gcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcatccattgct

SEQ ID NO: 3161 - DNA, 266 bp, Glycine max
  unsure (1)..(266): unsure at all n locations
tttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctatngaggaggtcaatatctttaaggatgacntatnatccagtttctaaatcccaaattcaagcanccat

SEQ ID NO: 3162 - DNA, 257 bp, Glycine max
gaaatttttcccaaagctgatcgagaagccagccaggccagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagaacaacaataga

SEQ ID NO: 3163 - DNA, 292 bp, Glycine max
gttaccatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtaattatccagtttctaaatcccaaagttcaagcatccattgctgctaatacttggg

SEQ ID NO: 3164 - DNA, 127 bp, Glycine max
gttaccatttgctcccagcactgagcttaaccgagcttcacaaagatgaatcgggaaaaattgatgaagatggccggttcggttagaactgggggaaagggcaccgtgagaagacagaagacggctg

SEQ ID NO: 3165 - DNA, 256 bp, Glycine max
gttaccatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatc

SEQ ID NO: 3166 - DNA, 250 bp, Glycine max
cgcaaacaaagaagttgcaggatatactccctagcattatccaccaattaggaccagataacttggaaaacctgaagatgcagggatggcattcacccctattctcttcagagcaccctgaagagaataggggtgcatgccatccctgctattgatgaggtccatatctttaaggatgacgtagttatccagtttctaaatcccaaagttcaagcatccatcgctgctaatacttgggttatcagtggtt

SEQ ID NO: 3167 - DNA, 243 bp, Glycine max
gttaccatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatacgtagttatcc

SEQ ID NO: 3168 - DNA, 236 bp, Glycine max
ccaatttgctcccagtacagagcttaaccgagcttcacgaagatgagtcgggaagagttgatgaagatggccggttcggttagaactgggggaaagggtaccatgagaagcaagaagaaggctgtccacaagacaacaaccacagatgacaagaggcttcagagcaccctgaagagaataggggtgaattccatcccggctattgaggaggtcaatatctttaacgatgacgtatt

SEQ ID NO: 3169 - DNA, 256 bp, Glycine max
cttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatc

SEQ ID NO: 3170 - DNA, 262 bp, Glycine max
cttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaag

SEQ ID NO: 3171 - DNA, 266 bp, Glycine max
catttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcat

SEQ ID NO: 3172 - DNA, 271 bp, Glycine max
catttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccatt

SEQ ID NO: 3173 - DNA, 258 bp, Glycine max
ctcgagccggttaccatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagaccataggggtgaatgccatcccggctattgaggaggtcaatatctttaaggatgacgtagttatccagttt

SEQ ID NO: 3174 - DNA, 256 bp, Glycine max; identical to SEQ ID NO: 3169

SEQ ID NO: 3175 - DNA, 249 bp, Glycine max
acaccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagacgtcaatatctttaaggatgacgtagttatccagtttcta

SEQ ID NO: 3176 - DNA, 259 bp, Glycine max
ccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcatcc

SEQ ID NO: 3177 - DNA, 252 bp, Glycine max
gttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttcta

SEQ ID NO: 3178 - DNA, 245 bp, Glycine max
gttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttat

SEQ ID NO: 3179 - DNA, 237 bp, Glycine max
gttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgac

SEQ ID NO: 3180 - DNA, 244 bp, Glycine max
cttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtattatccagtttcta

SEQ ID NO: 3181 - DNA, 241 bp, Glycine max
gttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaacaacagatgacaaaaggcttcagagcaccctgaagagaataggggtgaatgccatcccggctattgaggaggtcaatatctttaaggatgacgtagtta

SEQ ID NO: 3182 - DNA, 239 bp, Glycine max
ccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggggtcaatatctttaaggatgacgtagttatccagtttctaaa

SEQ ID NO: 3183 - DNA, 241 bp, Glycine max
gtcagacttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacg

SEQ ID NO: 3184 - DNA, 253 bp, Glycine max
gaaagaagaaggctgtccacaagacaacaaccacagatgacaaaaggcttcagagcaccctgaagagaataggggtgaatgccatcccggctattgaggaggtcaaatctttaaggatgacgtagttatccagtttctaaatcccaaagttcaagcatccattgctgctaatacttgggttgtcagtggttctccacaaacaaagaagttgcaggatatactccctagcattatccaccaattaggaccagat

SEQ ID NO: 3185 - DNA, 248 bp, Glycine max
gttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtt

SEQ ID NO: 3186 - DNA, 246 bp, Glycine max
cttagatagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatga

SEQ ID NO: 3187 - DNA, 253 bp, Glycine max
accatttgctcccagtacagagcttaaccgagcttcacaaagatgaatcgggaaaagttgatgaagatggccggttcggttagaactgggggaaagggtaccatgagaagaaagaagaaggctgtccacaagacaacaaccaccgatgaccaaaggcttcagagcaccctgaagagaataggggtgaatgccatcccggctattgaggaggtcaatatctttaaggatgacgtagttatccagtttctaaatc

SEQ ID NO: 3188 - DNA, 230 bp, Glycine max
gttaccatttgctcccagcactgagcttaaccgagcttcacaaagatgaatcgggaaaaattgatgaagatggccgtttcggttagaactgggggaaagggcaccgtgagaagaaagaagaaggctgttcacaagacaacaaccactgatgacaaaaggcttcagagcaccctgaagtgaataggggtgaattccatcccggctattgaggaggtcaatatctttaagga

SEQ ID NO: 3189 - DNA, 239 bp, Glycine max
cgagcttcacaaagatgaatcgggaaaaattgatgaagatggccggtgcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagca

SEQ ID NO: 3190 - DNA, 262 bp, Glycine max
accatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttc

SEQ ID NO: 3191 - DNA, 264 bp, Glycine max
accatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaa

SEQ ID NO: 3192 - DNA, 284 bp, Glycine max
gttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgc

SEQ ID NO: 3193 - DNA, 266 bp, Glycine max
ccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtgtctaaatcccaaagttcaagcatc

SEQ ID NO: 3194 - DNA, 201 bp, Glycine max
tgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaacctgaagagaataggggtgaatgccatccc

SEQ ID NO: 3195 - DNA, 247 bp, Glycine max
agatcattttcctatacttcgttttttatgagtctgatctttttgttctcagacttatgcatcatcttgtgctaaaacaaaaggagttgaagaatgggaagggggaagatcgaaatcaaaagatcgagaacacaacaaatcggcaagtgaccttcagcaagagaagaaatgggcttctgaagaaagcttatgagcagtcagtgctgtgtgatgctgaagtttccctcatcgtcatctccagccgtgg

SEQ ID NO: 3196 - DNA, 248 bp, Glycine max
  unsure (1)..(248): unsure at all n locations
ttttcttagatagagttgttaccatttgctcccagtacagagcttaaccgagcttcacaaagatgaatcgggaaaagttgatgaagatggccggttcggttagaactgggggaaagggtaccatgagaagaaagangaaggctgtccacaagacaacaaccacagatgacaaaaggcttcagagcaccctgaagagaataggggtgaatgccatcccggctattgaggaggtcaatatctttaaggat

SEQ ID NO: 3197 - DNA, 270 bp, Glycine max
ccagcactgagctttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtattatccagtttctaaatcccaaagttcaagcatccattgctgctaa

SEQ ID NO: 3198 - DNA, 266 bp, Glycine max
ccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtattatccagtttctaaatcccaaagttcaagcatccattgctgc

SEQ ID NO: 3199 - DNA, 121 bp, Glycine max
  unsure (1)..(121): unsure at all n locations
ccactgagcntaaccgagcttcacaaagatgaatcggnaaaaattnatgaagatngccggttcngntanaactgggggaaagggcaccgtgagangaacgaannaggcngtccacacaacc

SEQ ID NO: 3200 - DNA, 270 bp, Glycine max
cctgagttcaaggttaacaccaaataacacatatagtgcagattcataagctttcaaccatggaggatccaaatacaagctcaagaagggtcttctcagaagaaaatgggaagagggaagattgaaatcaaacggatcgagaacaccaccaataggcaagtcaccttctgcaagcgccgcaacggtttgctgaagaaagcttatgattatcagttctgtgtgatgcggaattgccctgttgtctctcaacccgtggcctttgtatgagta

SEQ ID NO: 3201 - DNA, 273 bp, Glycine max
  unsure (1)..(273): unsure at all n locations
caacactgagcttaaccgancttcgcaaagatgaatcgggaaaagttaatgaagatggccggttcggntagaactggaggaaanggtactgtgagangaaagaaganggctgnccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcntccattgctgcnaatact

SEQ ID NO: 3202 - DNA, 273 bp, Glycine max
cgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtattatccagtttctaaatcccaaagttcaagcatcc

SEQ ID NO: 3203 - DNA, 136 bp, Glycine max
cttaccatttgctcccagtacagagcttaaccgagcttcacaaagatgaatcgggaaaagttgatgaagatggccggttcggttagaactgggggaaagggtaccatgagaagacagaagaaggctgtccacaaga

SEQ ID NO: 3204 - DNA, 258 bp, Glycine max
gctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaag

SEQ ID NO: 3205 - DNA, 160 bp, Glycine max
acagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctg

SEQ ID NO: 3206 - DNA, 218 bp, Glycine max
gttaccatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaa

SEQ ID NO: 3207 - DNA, 192 bp, Glycine max
cttagtcagacttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaat

SEQ ID NO: 3208 - DNA, 208 bp, Glycine max
cttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattg

SEQ ID NO: 3209 - DNA, 94 bp, Glycine max
ggcttcagagcaccctgaagagaataggggtgaatgccatcccggctattgaggaggtcaatatctttaaggatgacgtagttatccagtttct

SEQ ID NO: 3210 - DNA, 190 bp, Glycine max
tagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaata

SEQ ID NO: 3211 - DNA, 248 bp, Glycine max
agagttgttaccatttgctcccagtacagagcttaaccgatcttcacaaagatgaatcgggaaaagttgatgaagatggccggttcggttagaactgggggaaagggtaccatgagtagaaagaagaaggctgtccacaagacaacaaccacagatgactcaaggcttcagagcaccctgaagagaataggggtgaatgccatcccggctattgaggaggtcaatatctttaaggatgacgtagttat

SEQ ID NO: 3212 - DNA, 114 bp, Glycine max
atgacaacgaccacagatgacaaaaggcttcagagcaccctgaagagaataggggtgaatgccatccctgctattgaagaggtcaatatctttaaggatgacgtagttatccag

SEQ ID NO: 3213 - DNA, 262 bp, Glycine max
aagacaacaaccacagatgacaaaaggcttcagagcaccctgaagagaataggggtgaatgccatccctgctattgaagaggtcaatatctttaaggatgacgtagttatccagtttctaaatcccaaagttcaagcatccattgctgctaatacttgggttgtcagtggttcaccgcaaacaaagaagttgcaggatatactccctagcattatccaccaattaggaccagataacttggaaaacctgaagaagctagccg

SEQ ID NO: 3214 - DNA, 257 bp, Glycine max
gttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcc

SEQ ID NO: 3215 - DNA, 276 bp, Glycine max
atttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgct

SEQ ID NO: 3216 - DNA, 279 bp, Glycine max
atttgctcccagcactgagcttaaccgagcttcacaaagatgaatcgggaaaaattgatgaagatggccggttcggttagaactgggggaaagggcaccgtgagaagaaagaagaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaata

SEQ ID NO: 3217 - DNA, 252 bp, Glycine max
cttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgccaaaaggcttcagagcaccctgaagagaataggggtgaatgccatccctgctattgaagaggtcaatatctttaaggatgacgtagttatccagtttctaaatccca

SEQ ID NO: 3218 - DNA, 150 bp, Glycine max
tagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaac

SEQ ID NO: 3219 - DNA, 252 bp, Glycine max
cttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttacggatgacgtagttatccagtttctaaatccca

SEQ ID NO: 3220 - DNA, 275 bp, Glycine max
cttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcatccattgctgct

SEQ ID NO: 3221 - DNA, 264 bp, Glycine max
tagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcc

SEQ ID NO: 3222 - DNA, 263 bp, Glycine max
gttaccatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccagagt

SEQ ID NO: 3223 - DNA, 284 bp, Glycine max
cttgctaccaacactgagcttaaccgagcttcgcaaagatgaaacgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcatccattgctgctaatacttgg

SEQ ID NO: 3224 - DNA, 241 bp, Glycine max
gcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctgcaaggatgacgtagttatccagtttctaaatcccaaagttcaagcatccat

SEQ ID NO: 3225 - DNA, 262 bp, Glycine max
gcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcatccattgctgctaata

SEQ ID NO: 3226 - DNA, 271 bp, Glycine max
cttcgcaaagatgaatcgggaaaagttaatgaagatggccggttcggttagaactggaggacagggtactgtgagaagaaagaagaaggctgtccacaagaccacaaccacagatgacaaaaggcttcagagcaccctgaagagaataggggtgaatgccatccctgctattgaagaggtcaatatctttaaggatgacgtagttatccagtttctaaatcccaaagttcaagcatccattgctgctaatacttgggttgtcagtggttca

SEQ ID NO: 3227 - DNA, 259 bp, Glycine max
  unsure (1)..(259): unsure at all n locations
cttgctaccaacactgagcttaaccgagcttcgcaaagatgaatcnggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtattatccagttctaaatcccaaagttcaag

SEQ ID NO: 3228 - DNA, 262 bp, Glycine max
ggattagaaatttttcccaaagctgatcgagaagccagccaggccagaaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagaga

SEQ ID NO: 3229 - DNA, 243 bp, Glycine max
ccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatcc

SEQ ID NO: 3230 - DNA, 281 bp, Glycine max
atgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcaaatacagatgctgcaaaattctaacaggcacctgatgggtgatgccttaagcacactg

SEQ ID NO: 3231 - DNA, 286 bp, Glycine max
tttggattagaaatttttcccaaagctgatcgagaagccagccaggccagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctga

SEQ ID NO: 3232 - DNA, 267 bp, Glycine max
ggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatgccaaagttcaagcatccattgctgctaatacttgggttgtcagtggttctccacaaacaaagaa

SEQ ID NO: 3233 - DNA, 233 bp, Glycine max
gaaatttttcccaaagctgatcaagaagccagccaggccagaaggagttgaagaatgggaagggggaagatcgaaatcaaaagaatcgagaacacaacaaatcggcaagtgaccttctgcaatagaagaaatgggcttctgaagaaagcttatgagctgtcagtgctgtgtgatgctgaagtttccctcaatcgtcttctccagccgtggccgtctctatgagtatgccaaca

SEQ ID NO: 3234 - DNA, 282 bp, Glycine max
atttgctcacagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatact

SEQ ID NO: 3235 - DNA, 232 bp, Glycine max
gtttcatttctttggattagaaatttttcccaaagctgatcgagaagccagccaggccagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagtgccccacagggttttctcaagggggggg

SEQ ID NO: 3236 - DNA, 263 bp, Glycine max
cttagatagagttgttaccatttgctcccagtacagagcttaaccgatcttcacgaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaatatgggtgaatgccgtcccggctattgaggaggtcaatatctttaaggatgacgtgttatccagtttct

SEQ ID NO: 3237 - DNA, 261 bp, Glycine max
atttctttggattagaaatttttcccaaagctgatcgagaagccagccaggccaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaacca

SEQ ID NO: 3238 - DNA, 192 bp, Glycine max
gtcagacttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagattaggg

SEQ ID NO: 3239 - DNA, 283 bp, Glycine max
cggctcgagatttctttggattagaaatttttcccaaagctgatcgagaagccagccaggccagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagag

SEQ ID NO: 3240 - DNA, 432 bp, Glycine max
agtacagctgcgagaagacgacagaaggggatagcgaagtttcatttctttggattagaaatttttcccaaagctgatcgagaagccagccaggccaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcggatcattcaagtgcgaacactaacacaggaattccatgcccaattataccaacaagaatctgctaagctgcgacagcaaatacagatgctgcaaaattctaa

SEQ ID NO: 3241 - DNA, 356 bp, Glycine max
gacccacacgtaagtacggctgcgagaagacgacagaagggggaggttttcttagttattgttaccatttgctcccagcactgagcttaaccgagcttcacaaagatgaatcgggaaaaattgatgaagatggccggttcggttagaactgggggaaagggcaccgtgtgaagaaagaagaatgctgtccacaagacaacaaccacagatgacaaaaggcttcagagcaccctgaagagaataggggtgaatgccatcccggctattgaggaggtcaatatctttaaggatgacgtacttatccagtttctaaatcccaaagttcaagcatgcattgctggctaatacttgggttg

SEQ ID NO: 3242 - DNA, 365 bp, Glycine max
gacccacgcgtcagtacagctgcgagaagacgacaaaaggggaataccaaattttcaattcctttggataaaaaattttccccaaagctgatcgagaagccagccaggccaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcggatcattcaagtgcgagcact

SEQ ID NO: 3243 - DNA, 343 bp, Glycine max
cgggccgacccacacgtccatacggctgcgagaagacgacagaaggggagggttttctgagttattgttaccatttgctcccagcactgagcttaacggagcttcacaaagatgaatcgggaaaaattgatgagtatggccggttcggttagaactgggggaaagggcaccgtgagaagaaagaagaaggctgtcgacaagactacaaccaggagtgatagaaggcttcagagcaccctgaagagaataggggtgagtgccatcccggctattgaggaggtcaatatcattaaggatgacgtagttatccagtttctaaatctcatcgttcaagcatccagtg

SEQ ID NO: 3244 - DNA, 437 bp, Glycine max
cgggcagccacgcgtccatacgactgcgagaagacgacagaaggggatagcgaagtttcatttctttggagtacaaatttttcccaaagctgatcgataagccagccaggccaggagttgaagaatgggaaaggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcggatcattcaagtgcgagcactaccacagaaatcaatgctcagtattatcaacaagaatctgctaagctgcgacagcaaatacagatgctgc

SEQ ID NO: 3245 - DNA, 368 bp, Glycine max
atccaagcgtccgtacggctgcgagaggacgacagaaggggatagcgcagttgcaattcattggattacaaatttttcccaaagctgatcgagaagccagccaggccagaaagagttgaagaagaatgggaagggggaagatcgagatcaaaaggattgagaacacaacaaatcggcaagtgaccttctgcaagagaagaaatgggcttctgaagaaagcttatgagctgtcagtgctgtgtgatgcagaagttgccctcatcgtcttctccaaccgtggccgtctctatgagtactccaacagcaacataagatcaacaatacagaggtacaaaaaggcatgttctgatcactcaagcgcgagcact

SEQ ID NO: 3246 - DNA, 428 bp, Glycine max
  unsure (1)..(428): unsure at all n locations
agcccacgcgtccgtacggctgcgagaagacgacagaaggggatagcgcagtttcatttctttggattagaaatttttcccaaagctgatcgagaagccagccaggccagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcanatacag

SEQ ID NO: 3247 - DNA, 304 bp, Glycine max
cgggtcgaaccaagcgtccgcccacgcgtccgtacggctgcgagaagacgacagaaggggatagcgaagtttcatttctttggattagaaatttttcccaaagctgatcgagaagccagccaggccagaaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctcc

SEQ ID NO: 3248 - DNA, 413 bp, Glycine max
tacggctgcgagaagacgacagaagggatagcgaagtttcatttctttggattagaaatttttcccaaagctgatcgagaagccagccaggccaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcggatcattcaagtgcgagcactaccacagaaatcaatgctcagtaatatcaacaagaatctgctaagctgcgacagcaaatacagat

SEQ ID NO: 3249 - DNA, 307 bp, Glycine max
acggctgcgagaagacgacagaaggggggattagaaatttttcccaaagctgatcgagaagccagccaggccaggagttgaagaatgggaagggggaagatcgaaatcaaaagaatcgagaacacaacaaatcggcaggtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcgg

SEQ ID NO: 3250 - DNA, 316 bp, Glycine max
ccgggccgacccacgacgtcagtacggctgcgagaagacgacagaaggggatatagcgaagtttcatttctttggattagaaatttttcccaaagctgatcgagaagccagccaggccaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattcaacaacaacataa

SEQ ID NO: 3251 - DNA, 371 bp, Glycine max
ccaacactgatcttaaccgagcttcgtaaagatgaatcgggaaaagtttatgaagatggacggttccgttagaactggatgaaagggtactgctagaagaaagaagaaggctgtctacaagacaacaaccacagatgacaaaaggcttcagagcaccctgtacagaataggggtgaatgccatccctgctattgaagaggtcaatatctttaacgatgacgtctatatccagtttctaaatcccaaagttcaagcatacattgctgctcatacttgcgttgtcagtggctcaccgcaaacaatagaattgcacgatatactccctagcattatacaccaattaggaccagataactcggaagacctgaaga

SEQ ID NO: 3252 - DNA, 441 bp, Glycine max
cccacgcgtccgtacggctgcgagaagacgacagaaggggaggttttcttagatagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaacagagaagttgcaagatatactcgctagcattatccagcaattaggaccagataacatagaaaacctg

SEQ ID NO: 3253 - DNA, 393 bp, Glycine max
cccacgcgtcagcccacgcgtccgtgctgctgccacaagacgacaaaagggtacggctgcgagaataccacacaacggtactgctgcgataacactacataacggtacggctgcgacaagacgacagaagggtacggctgcgagaagacgacagaaggggaacggcgtttccaccagcggtgactctctgagatctattcctacgccgtttctcaccaaaaccttccaactcgtccacgatcacaccatcgaccatgtgatttcgttgaacgactctggattctccttcatcgtctggaacaccaccgcttttcgccaaaggatttgcttcctaaatatttcaatcacaacaacttctccaacttcattccccaactcaacacttacggattc

SEQ ID NO: 3254 - DNA, 454 bp, Glycine max
  unsure (1)..(454): unsure at all n locations
acgcgtccgcccacgcgtccgacggctgcgagaagacgacagaaggggcaggctcgtttatataaaagggagtccttatcttctcgcattgttttaggttttcttagatagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaatangggtgaatgccatcccggctattgaggaggtcaatatctttaaggatgacgtagttatccagtttctaaatcccanagttcaagcatccattgctgctaatacttgggttgtcagtggttctccacaaacaaagaagttgcaagatatactccct

SEQ ID NO: 3255 - DNA, 409 bp, Glycine max
agacggctgcgagaagacgacagaagggggttttaggttttcttagatagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaacaaagaagttgcaagatatactccctagcattatccaccaat

SEQ ID NO: 3256 - DNA, 412 bp, Glycine max
  unsure (1)..(412): unsure at all n locations
cacgcgtcagtacggctgcgagaagacgacagaagggggaaggctcgttgatataaaagggagtccttatcttctcatattgtttaggttttcttagtcagacttaccccttgctaccaacactgagcttaaccgagcttcgcaaagatgaatcgggaaaagttaatgaagatggctggttcggttagaactggaggaaagggtactgtgagaagaaagaagaaggctgtccacaagacaacaaccacagatgacaaaaggcttcagagcaccctgaagagaatangggtgaatgccatccctgctattgaagaggtcaatatctttaaggatgacgtagttatccagtttctaaatcccagagttcaagcatccattgctgctaatacttgggttgtcagtggttcaccgc

SEQ ID NO: 3257 - DNA, 396 bp, Glycine max
agcccacgcgtccgtacggctgcgagaagacgacagaagggggtttaggttttcttagtcagacttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcatccattgctgctaatacttgggttgtcagtggttcaccgcaaacaaagaagttgcaggatata

SEQ ID NO: 3258 - DNA, 410 bp, Glycine max
cccacgcgtccgtacggctgcgagaagacgacagaaggggaggttttctgagttattgttaccatttgctcccagcactgagcttaaccgagcttcacaaagatgaatcgggaaaaattgatgaatatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaacaaagaagttgcaggatatactccctagcattatccacca

SEQ ID NO: 3259 - DNA, 419 bp, Glycine max
accacgcgtccgtacggctgcgagaagacgacagaaggggaagatggccggttcggttagaactggaggaaagggtactgtgagaagaaagaagaaggctgtccacaagacaacaaccacagatgacaaaaggcttcagagcaccctgaagagaataggggtgaatgccatccctgctattgaagaggtcaatatctttaaggatgacgtagttatccagtttctaaatcccaaagttcaagcatccattgctgctaatacttgggttgtcagtggttcaccgcaaacaaagaagttgcaggatatactccctagcattatccaccaattaggaccagataacttggaaaacctgaagaagctagccgagcaattccagaagcaggctcctgaaagggccgctggttcaaccacagctc

SEQ ID NO: 3260 - DNA, 422 bp, Glycine max
acggctgcgagaagacgacagaagggggttttaggttttcttagatagagttgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaacaaagaagttgcaagatatactccctagcattatccaccaattaggaccagataact

SEQ ID NO: 3261 - DNA, 400 bp, Glycine max
atacagctgcgagaagacgacagaaggggatggaaactggaggctttcatggctaccgcaagctccccaacacaacctctgggttgaagctgtcagtgtcagacatgaacatgaacatgaggcagcagcaggtagcatcatcagatcagaactgcagcaaccacagtgcagcaggagaggagaacgaatgcacggtgagggagcaagacaggttcatgccaatcgctaacgtgatacggatcatgcgcaagattctccctccacacgcaaaaatctccgatgatgcaaaggagacaatccaagagtgcgtgtcggagtacatcagcttcatcaccggggagggcaacgagcgttgccagaggggtgcaacgcaagaccatagccgcagaggacgtgcttt

SEQ ID NO: 3262 - DNA, 427 bp, Glycine max
  unsure (1)..(427): unsure at all n locations
acccacgcgtccgaagacgacagaagggggcctacttcatctctcttataatcacacacacctaccttatagctatggaaactggaggctttcatggctaccgcaagctccccaacacaacctctgggttgaagctgtcagtgtcagacatgaacatgaacatgaggcagcagcaggtagcatcatcagatcagaactgcagcaaccacagtgcagcaggagaggagaacgaatgcacggtgagggagcaagacaggttcatgccaatcgctaacgtgatacggatcatgcgcaagattctccctccacacgcaaaaatctccgatgatgcaaaggagacaatccaagagtgcgtgtcggagtacatcagcttcatcaccggggaggccaacgagcgttgccaganggagcagcgcaagaacataac

SEQ ID NO: 3263 - DNA, 391 bp, Glycine max
ggctcgagccacgcgtcagtccaagcgtccgtacggctgcgagaagacgacagaaggggggaacaagtgggccaccatcgcgcgcttcctcaatggccgcaccgacaacgccatcaagaaccattggaattccaccctcaagaggaagtgctccgagcctctctccgagcctcggcctctgaagagatccgccaccgtttcgggtagtcaatccggatccgatttgagcgattcgggtttacccattattcttgcaagaagcgtgagcgtgacggtagctccctctaaccaccttgcggaaaccgcgtcttcttcagtaactgatcctgccacgttattgagtttgtctctaccgggattcgattcgtgcgatggggctaataatgggcct

SEQ ID NO: 3264 - DNA, 402 bp, Glycine max
aattaacatttgctcccagcactgagcttaaccgagcttcacaaagatgaatcgggaaaaattgatgaagatggccggttcggttagaactgggggaaagggcaccgtgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaacaaagaagttgcaggatatactccctagcattatccaccaattaggaccagataacttggaaaacctgaagaagctggccgagcaatt

SEQ ID NO: 3265 - DNA, 435 bp, Glycine max
atttgctcccagtacagagcttaaccgagcttcacaaagatgaatcgggaaaagttggtgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaacaaagaagttgcaagatatactccctagcattatccaccaattaggaccagataacttagaaaacctgaagaagctagccgagcaattccagaagcaggctcctgaaagagccgtcggttcaaccaca

SEQ ID NO: 3266 - DNA, 345 bp, Glycine max
tgttaccatttgctcccagtacagagcttaaccgagcttcacaaagatgaatcgggaaaagttgatgaagatggccggttcggttagaactgggggaaagggtaccatgagaagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaaccaagaagttgcaagatatactccctagcat

SEQ ID NO: 3267 - DNA, 386 bp, Glycine max
gacccacgcgtaagcccacgcgtccgtacggctgcgagaagacgacagaaggggaggttttcttagtcagacttaccccttgctaccaacactgagcttaaccgagcttcgcaaagatgaatcgggaaaagttaatgaagatggccggttcggttagaactggaggaaagggtactgtgagaagaaagaagaaggctgtccacaagacaacacccacagatgacaaaaggcttcagagcaccctgaagagaataggggtgactgccatccctgctattgaagaggtcaatatctttaaggatgacgtagttatccagtttctaaatcccaaacttcaagcatccattgctgctaatacttgggttgtcagtgggtcaccgcaaaca

SEQ ID NO: 3268 - DNA, 448 bp, Glycine max
  unsure (1)..(448): unsure at all n locations
gccgaccgacgcgtccaacgactgagagaagacgacagaagggggttttaggttttcttagtcagacttaccccttgctaccaacactgagcttaaccgagcttcgcaaagatgaatcgggaaaagttaatgaagatggccggttcggttagaactggaggaaagggtactgtgagaagaaagaagaatgctgtccacaagacaacaaccacagatgacaaaaggcttcagagcaccctgaagagaataagggtgaatgccatccctgctattgaagaggtcaatatctttaaggatgacgtanttatccagtttctaaatcccaaagttcaagcaatcaattgctgctaatactttgggtgtcagtggttcaccgcaaacaanagaagttgcaggatatactccctagcattattcaccaattatgaccagataacttggaaaaacc

SEQ ID NO: 3269 - DNA, 231 bp, Glycine max
attacctccaccccgatctcaaacgagggaagctcacaccccaagaagaacacctcgtcatggaccttcattccaaatggggaaataggtttgagaaccatgcagaaataattaaactataagctacctaccttccaatcatcatcactcataattttaattaattttttcctaccatacagtactattagtattaattagttctttgtcttatgtttttgttttttaata

SEQ ID NO: 3270 - DNA, 264 bp, Glycine max
tcgagctctgctttctgtgttattgtctggcttttggagccgatccaaccaatcatcgctgactgccaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaacttcccattgccaacatcagccgcatcatgaagaaggct

SEQ ID NO: 3271 - DNA, 397 bp, Glycine max
tatttctcacactcgcaagtctcaagcaactcacacaggaagcggcaaacaaagcacacagaaagtaaaaagcggaaattaaggagcggtggtgacggtggtagtgaataaataaaagcagcaccataccatggggggagaagaagtagcaagagtcaaagcagagttgttcgacgacaacgaaagcgatcgcaacgacgacgacgttttgagcgagagcaaggactcgggagtgacgacggctcacgcagtgaaagaagagatggatgacggcgccgctaactggtcttcgtcgtcgtcgacttcgcccaaaccgatggaagggttgcacgaggtgggcccccctccgttcctgaagaagacgtttgaaatggtggaagaccctcacaccaaaccc

SEQ ID NO: 3272 - DNA, 438 bp, Glycine max
cccacgcgtccgcggacgcgtggggcaggaccctcctgaagatgctgttgtttcagtttgtggtcatgttttttgtaaccagtgcatttgtgaatatcttactggtgatgacaatcagtgccctgctccaaactgcaaaactcgactaagcacgccttcagtgttttccaaagtcacactgaatagttctttttctgatcagccttgtgataatttgcctgattactctggttgtgaagtggaggaatctgagttttgttctcaggctcagccatatgattcttcaaaaattaaggctgcacttgaggtgttgcagtcgttgtctaaaccacaatgctttgcttcccaaaacaattctgtgcagagcacttctggggaaagtaccgatggccttggtagctcctctagtgctgacagaatgaaatccttgaatgaaat

SEQ ID NO: 3273 - DNA, 258 bp, Glycine max
gaaagttgaagaaacaatggcgtatgctaatgctgcttcaactagcccaacaacatcttcaaacctctccccgcaacccatggaagggttgcacgaggtgggtccccctccgtttctcaccaaaaccttcgacgtggtggaagacccatccaccaacgacatcgtttcgtggagcagatcccgcaacagtttcgtcgtttgggactctcacaagttctctaccaccatcctgcctcgctacttcaagcacaacaattt

SEQ ID NO: 3274 - DNA, 248 bp, Glycine max
acacactcaatgaagggagttacagtgagagttgaagagacaatggcgtatgctaatgctgcttcaactagcccaacaacatcttcaaacctctccccgcaacccatggaagggttgcacgaggtgggtcccctccgtttctcaccaaaaccttcgacgtggtggaagacccatccaccaacgacatcgtttcgtggagcagatcccgcaacagtttcgtcgtttgggactctcacaagttctctacc

SEQ ID NO: 3275 - DNA, 243 bp, Glycine max
ctcaatgaagggagttacagtgaaagttgaagaaacaatggcgtatgctaatgctgcttcaactagcccagcaacatgcttcaaacctctccccgcaacccatggaagggttgcacgaggtgggtccccctccgtttctcaccaaaaccttcgacgttgtggaagacccatccaccaacgacatcgtttcgtggagcagagcccgcaacagtttcgtcgtttgggactctcacaagttctcta

SEQ ID NO: 3276 - DNA, 298 bp, Glycine max
  unsure (1)..(298): unsure at all n locations
ctcaatgaagggagttacagtgaaagttgaagaaacaatggcgtatgctaatgctgcttcaactagcncaacaaacatcttcaaacctctccccgcaacccatggaagggttgcacgaggtgggtccccctcngtttctcaccaaanccttcgacgggtggaagacccatccaccaacgacatcgtttcgtggagcagatcccgcaacagtttcgtcgtttgggactctcacaagttctctaccaccatcctgcctcgctattcanncacaacaattcttccagcttcgtacgacaac

SEQ ID NO: 3277 - DNA, 268 bp, Glycine max
cattcacacactcaatgaagggagttacagtgaaagttgaagaaacaatggcgtatgctaatgctgcttcaactagcccaacaacatcttcaaacctctccccgcaacccatggaagggttgcacgaggtgggtccccctccgtttctcaccaaaaccttcgccgtggtggaagacccatccaccaacgacatcgtttcgtggagcagatcccgcaacagtttcgtcgtttgggactctcacaagttctctaccaccatcctgcctcg

SEQ ID NO: 3278 - DNA, 275 bp, Glycine max
  unsure (1)..(275): unsure at all n locations
caaagttgaagaaacaatggcgtatgctaatgctgcttcaactagcccaacaacatcttcaaacctctccccgcaactcatggactccgntgcacgaggtgggtcccactccgtttctcaccaaaaccttcgacgtggtggaagacccatccaccaacgacatcgtttccgnggagcagagcccgcaacagtttcgtcgtttggagatctcacaagttctccaccaccatcctgcctcgctacttcaagcacaacaatttctccagcttcgtacg

SEQ ID NO: 3279 - DNA, 268 bp, Glycine max
cctcgagccgcatcggctcgagcacacactcaatgacgggagttaacgtgaaagttgaagaaccaatggcgtatgctcaatgctgcttcaactagcccagcaacatcttcaaacctctccccgcaacccatggaagggttgcacgaggtgggtccccctccgtttctcaccaaaaccttcgacgttgtggaagacccatccaccaacgatatcgtttcgtggagcagagcccgcaacagtttcgtcgtttgggcactctcacaagttc

SEQ ID NO: 3280 - DNA, 278 bp, Glycine max
gtgaaagttgaagaaacaatggcgtatgctaatgctgcttcaactagcccaacaacatcttcaaacctctccccgcaacccatggaatcagttgcacgaggtgggtccccctccgtttctcaccaaaaccttcgacgtggtggaagacccatccaccaacgacatcgtttcgtggagcagatcccgcaacagtttcgtcgtttgggactctcacaagttctctaccaccatcctgcctcgctacttcaagcacaacaatttctccagcttcgtacgac

SEQ ID NO: 3281 - DNA, 261 bp, Glycine max
cgtttcctctgccctattggtcaggatacagtccagagcccaccaagaaggcggaaacacatgaagtgctgaaaccaactgcagtacattctaaaagccctatcaatgttgatgaactggttggcatatcaaaactgagtttaggggagtctattggtgactcgggtccctccaccctgtctcgaaaacttattgaagaaggaccctctagacaatcagcttttcatgcaacaccaacatgtggtgatatgaatggcagtg

SEQ ID NO: 3282 - DNA, 253 bp, Glycine max
  unsure (1)..(253): unsure at all n locations
cgnnnnctgtgcacnatnggtaaggatatagtaanncagnccancaagaaggngganacacatgaagtgctgaaancaactgaagnacatacnnaaagccntatcaatgttgatgaactggttngcatatcaaaactgagtttaggggagtctattggtgactcgggtcccnccaccctgtctgaaaacttattgaagaaggaccctctagacaatcagcttttcatgcnacaccaacatgtggtgatatgaa

SEQ ID NO: 3283 - DNA, 263 bp, Glycine max
aaacaacacacctcgctcacttcttcttcttcctcctcctccctctctcacaatttttattttttaatgatactattttgttattgttattgatggtatcatcatcgggaaaaagcagtgaaatggatagggtgaagggtccatggagcccagaagaggacgaggccctgcgggcgctggttcaggcccacgggcctcgaaactggtcggtgataagcaagtccattccggggagatccgggaaatcgtgccgttacggtggt

SEQ ID NO: 3284 - DNA, 266 bp, Glycine max
aaacaacacacctcgctcacttcttcttcttcctcctcctccctctctcacaatttttattttttaatgatactattttgttattgttattgatggtatcatcatcgggaaaaagcagagaaatggatagggtgaaggtccatggagcccagaagaggacgaggccctgcgggcgctggttcaggcccacgggcctcgaaactggtcggtgataagcaagtccattccggggagatccgggaaatcgtgccgcttacggtggtgca

SEQ ID NO: 3285 - DNA, 229 bp, Glycine max
ctcgctcacttcttcttcttcctcctcctccctctctcacaattactattttttaatgatactattttgttattgttattgatggtatcatcatcgggaaaaagcagagaaatggatagggtgaagggtccatggagcccagaagaggacgaagccctgcgggcgctggttcaggcccacgggcctcgaaactggtcggtgataagcaagtccattccggggagatccg

SEQ ID NO: 3286 - DNA, 250 bp, Glycine max
caacacacctcgctcacttcttcttcttcctcctcctccctctctcacaatttttattttttaatgatactattttgttattgttattgatggtatcatcatcgggaaaaagcagagaaatggatagggtgaagggtccatggagcccagaagaggacgaggccctgcgggcgctggttcaggcccacgggcctcgaaactggtcggtgataagcaagtccattccggggagatccgggaaatcgtgccg

SEQ ID NO: 3287 - DNA, 223 bp, Glycine max
caaaacaacacacctcgctcacttcttcttcttcctcctcctccctctctcacaatttttattttttaatgatactattttgttattgttattgatggtatcatcatcgggaaaaagcagagaaatggatagggtgaagggtccatggagcccagaagaggacgaggccctgcgggcgctggttcaggcccacgggcctcgaaactggtcggtgataagcaag

SEQ ID NO: 3288 - DNA, 252 bp, Glycine max
ctcgctcacttcttcttcttcctcctcctccctctctcacaatttttattttttaatgatactattttgttattgttattgatggtatcatcatcgggaaaaagcagagaaatggatagggtgaagggtccatggagcccagaagaggacgaggccctgcgggcgctggttcaggcccacgggcctcgaaactggtcggtgataagcaagtccattccggggagatccgggaatcgtcccgcttacggtggt

SEQ ID NO: 3289 - DNA, 256 bp, Glycine max
tatagaaaagaaactcaagaaccgaattcaatggaagggactggatgtttcaagaccgggtgaggctgatgatagtcttcctagtttacaggcagaagttgaaaatttaacaatgaaggagcgccagttagatgaacaaataagggagatgcaagacagactgcgagatcttagtgaagatgaaaataatgacaagttgctttctgttactgaggaggatataaagaatttgccctgcttccagaatgaaacctta

SEQ ID NO: 3290 - DNA, 251 bp, Glycine max
gaagcattgaaggacgtagctgctatggctcgaggaaagatccagatcaagaggatagagaacaccaccaaccgccaggtcacttattctaaacgacggaatggccttttcaagaaggccaacgagctcaccgttctatgcgatgccaaggtttctattattatgttctccagcactgggaaactccacgagtacatcagcccctccacctcaacaaagcagttcttcgatcagtaccagatgactctagg

SEQ ID NO: 3291 - DNA, 229 bp, Glycine max
gatcgatcgaacaagtgaattagctagaagcattgaaggacgtagctgctatggctcgaggaaagatccagatcaagaggatagagaacaccaccaaccgccaggtcacttattctaaacgacggaatggccttttcaagaaggccaacgagctcaccgttctatgcgatgccaaggtttctattattatgttctccagcactgggaaactccacgagtacatcagccc

SEQ ID NO: 3292 - DNA, 285 bp, Glycine max
gctgctagctattagctatggctagaggaaagatccagatcaagaggatagagaacaacaccaaccgccaggtcacttactctaaacgacggaatggccttttcaagaaggccaacgagcttaccgttctctgcgatgccaaggtttctatattatgttctccagcactggaaaactccaccagtacatcagcccctccacctcaacaaagcagttcttcgatcaataccagatgactctgggagttgatctctggaactctcattacgagaatatgcaagagaa

SEQ ID NO: 3293 - DNA, 298 bp, Glycine max
tacggctgcgagaagacgacagaagggggaagaagctgctagctattagctatggctagaggaaagatccagatcaagaggatagagaacaacaccaaccgccaggtcacttactctaaacgacggaatggccttttcaagaaggccaacgagcttaccgttctctgcgatgccaaggtttctattattatgttctccagcactggaaaactccaccagtacatcagcccctccacctcaacaaagcagttcttcgatcaataccagatgactctgggagttgatctctggaactctc

SEQ ID NO: 3294 - DNA, 407 bp, Glycine max
gaagcattgaaggacgtagctgctatggctcgaggaaagatccagatcaagaggatagagaacaccaccaaccgccaggtcacttattctaaacgacggaatggccttttcaagaaggccaacgagctcaccgttctatgcgatgccaaggtttctattattatgttctccagcactgggaaactccacgagtacatcagcccctccacctcaacaaagcagttcttcgatcagtaccagatgactctaggagtcgatctctggaactctcattacgagaatatgcaagagaacttgaagaaactcaaagatgtgaataggaatcttcgtaaggagattaggcagaggatgggagattgtctgaacgatctgagcatggaagatctcaagctccttgaggaagaaat

SEQ ID NO: 3295 - DNA, 264 bp, Glycine max
  unsure (1)..(264): unsure at all n locations
tgnctaaaggagaagaagcaacagctgagcttgatgctaagatgaaaaaactttactgaagatgctatcaaatttaagatggatgacactgctgagttgtatgattttgatgatgagaaggatgagaacaaatttgatttaaaaaaattgtgagtgaaaattgggtcgagccaccaagaagagaacggaagcgcaattactcggagtctgaatacttcaagcaaacaatgcgccaaggtggccctactaaaccaaaagagcctc

SEQ ID NO: 3296 - DNA, 254 bp, Glycine max
catatacattttttagccttttgttagccccaaacacccacacgggcacacccctgcaggtacaaaagggggagttcacaacaaaaagaaaacaatgagaaaaccttgttgtgacaaggaaaacatcaataaaggtgcttggtccaagcaagaagaccaaaagctcattgactacatccaagtccatggtgaaggctgttggcgttccattcctaaagctgctgggctgcatcgttgtggcaaaagctgtagga

SEQ ID NO: 3297 - DNA, 278 bp, Glycine max
  unsure (1)..(278): unsure at all n locations
agggttccgagtttgaagttgaaagtgttnaactatctctagctagcttttcacaaatttngttgcacttgcaactgaggcaggaaagaggggcacgagaggaggaagaggaaagagaagaaaaaccaagaaaagtggagaaagggataggtgttgtacagaaatagaaattaaaattgagtnanaattaaagagaagaaggagtgatagggagatatgggtaggggaagagtggagttgaagaggatagagancaagataaacaggcaagtcacgtt

SEQ ID NO: 3298 - DNA, 262 bp, Glycine max
cgagtttgaagttgaaagtgttgaactatctctagctagcttttcacaaatttggttgcacttgcaactgaggcaggaaagaggggcacgagaggaggaagaggaaagagaagaaaaaccaagaaaagtggagaaagggataggtgttgtacagaaatagaaattaaaattgagtgaaaattaaagagaagaaggagtgatagggagatatgggtaggggaagagtggagttgaagaggatagagaacaagataaacaggca

SEQ ID NO: 3299 - DNA, 252 bp, Glycine max
ccacatacctttgtcattattagtcttgatccccctattcgaaagggacaaactttgtaccctcatattgtgatgcagtttgaaactgattatgttgttgaaagtgaattggcaataaatgaagatctttataacacaaagttcaaggacaagttggagctgtcttataagggtcttattcatgaagtgttcaccacaatattacgtggtttgtctggtgccaaagtgaccaagcccggaaaatttaggagt

SEQ ID NO: 3300 - DNA, 255 bp, Glycine max
ttttacttcctaagtctaatcaaccacatacctttgtcattattagtcttgatccccctattcgaaagggacaaactttgtaccctcatattgtgatgcagtttgaaactgattatgttgtctaaagtgaattggcaataaatgaagatctttataacacaaagttcaaggacaagttggagctgtcttataagggtcttattcatgaagtgttcaccacaatattacgtgttttgtctggtgccaaagtgacca

SEQ ID NO: 3301 - DNA, 256 bp, Glycine max
gggatggagaggagtgctgggggtgagattgcgcccaccactaggcactataggagtgtctccatggatagtttcattgggaagttgaattccgataaggagtcgcccaagctgcctccttcccccgggcagagaagtgctctgatgtcgctgctggtgggaattgatgggattcgggcggccttcagcttggagtttggaaatggggagttcagtgggcctgaactgaagaaaattatggccaatgaaaagcttg

SEQ ID NO: 3302 - DNA, 278 bp, Glycine max
atgagagtgggcatggagggagttagaagagggaagggatgaaaaggagtgctgggggtgagattgcaccaactacaaggcactataggagtgtctccatggatagtttcattgggaagttgaatttcggtgacgagtcgccgaagctgcctccttcgccggggcagagaggtggtttgatgtcgcctgcgggtggaattgatgggaattcggcggccttcagcttggagtttggaaatggggagtttagtgggcctgaattgaagaaaattatggcc

SEQ ID NO: 3303 - DNA, 242 bp, Glycine max
ggagtgctgggggtgagattgcgcccaccactaggcactataggagtgtctccatggatagtttcattgggaagttgaatttcgatgaggagtcgcccaagctgcctccttcccccgggcagagaagtgctctgatgtcgcctgctggtggaattgatgggaattcggcggccttcagcttggagtttggaaatggggagttcagtgggcctgaactgaagaaaattatggccaatgaaaag

SEQ ID NO: 3304 - DNA, 290 bp, Glycine max
  unsure (1)..(290): unsure at all n locations
cagtaatggaaataacaacaacagtaacagctctgtcaccgccgccttcggaaggcgtggggtccacccacaccgtgagtccacggccaccaccgagacttcgatctcaacatcccggcttttgccggatttttcgaccaaggtcggagaagacgaggttgagagccctcaccctgtcatgaagaagcctcgccccttcgtcattcccaagatcgaaatccctcaatatcaatgaatctatgaattttttatnnttatntttttcgattattttggagaattttgagatt

SEQ ID NO: 3305 - DNA, 282 bp, Glycine max
  unsure (1)..(282): unsure at all n locations
agtaatggaaataacaacaacagtaacagctctgtcaccgccgcctcggaaggngtggggtccacccacaccgtgagtcacggccaccaccgagacttcgatctcaacatcccggcttttccggatttttcgaccaaggtcggagaaacgaggttgagagccctcaccctgtcatgaagaagcctcgccccttcgtcattcccaagatcgaaatccctcaatatcaatgaatctatgaattttttatttttatttttttcgattattttggagattttgaga

SEQ ID NO: 3306 - DNA, 250 bp, Glycine max
ctcgtttcattcttttccttcttttgtcttcccttagtttgaagatcatggggagagggagggttcagctgaagcagatcgagaataaaatcagccgccaagtgacgttttccaaaaggagaactgggctgcgcaagaaagccaacgagatctctgtgctctgtgatgctcaagtagcactgattgtgctcaatgctaaagggaagccttttgagtaatcttctgaatccagcatggaaacgtgctggaa

SEQ ID NO: 3307 - DNA, 245 bp, Glycine max
ctcttctcatttcattcttcttccttcttttgtcttcccttagcttagtttgaagatcatggggagaggaagggttcagctgaagcagatcgagaacaaaatcagccgccaagtgacgttttccaaaaggagaactgggctgcgaaagaaagctaatgaaatctctgtgctctgtgatgctcaagtggcactgattgtgttcaatgctaaagggaagctttttgagtattcttctgaatccagca

SEQ ID NO: 3308 - DNA, 252 bp, Glycine max
tttaagtcctgcatatatatgcgtagttttttttatagttttagtgagtgagaatagccatgtctacttcaaagagcgtcacagttctagtgaagatgacaatgaacttagaagagggccttggactcttgaagaggataatttgctctcccaatatatttctagtcatggagaagggcgatggaatttgctagctaaacgttcaggattaaagcgaactgggaaaattgcagattaaggtggctaaattat

SEQ ID NO: 3309 - DNA, 236 bp, Glycine max
gccatgtctacttcaaagagcgtcagcagttctagtgaagatgacaatgaacttagaagagggccttggactcttgaagaggataatttgctctcccaatatatttctagtcatggagaagggcgatggaatttgctagctaaacgttcaggattaaagcgaactgggaaaagttgcagattaaggtggctaaattatctaaagccagatgtaaaacggggaaatttaaccccaca

SEQ ID NO: 3310 - DNA, 235 bp, Glycine max
  unsure (1)..(235): unsure at all n locations
ctcgttgtggttaggtcttcttcacctttcgaattttggaatccatgggtcagggaactccgggcggcatgaaccggcagggcgaccggaagccggacggcggcgancaagaaggagaagaagttcgagccgtcggctccgccggcgcgcgtggggcggaaacagcggaagcagaaaggtccggaggcggcggcgcggttgccgacagtgactccggtgacgaatgcaaatgcgg

SEQ ID NO: 3311 - DNA, 250 bp, Glycine max
gttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggatgcggcggcgcggttgccgacagtgactccggtgacgaagtgcaaactgcggcttctgaagctggagcggatcaa

SEQ ID NO: 3312 - DNA, 246 bp, Glycine max
gttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacagtgactccggtgacgaagtgcaaactgcggcttctgaagctggagcgga

SEQ ID NO: 3313 - DNA, 265 bp, Glycine max
ctggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacagtgactccggtgacgaagtgcaaactgcggcttctgaagctggagc

SEQ ID NO: 3314 - DNA, 272 bp, Glycine max
ctaaacacggggcactggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacagtgactccggtgacgaagtgcaaactgcggcttctgaag

SEQ ID NO: 3315 - DNA, 226 bp, Glycine max
ggggcactggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacag

SEQ ID NO: 3316 - DNA, 271 bp, Glycine max
  unsure (1)..(271): unsure at all n locations
gttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacagtgactccggtgacgattgcaaactgcggcttctgaagctggagcggntcaagnactaccttctgatggaggag

SEQ ID NO: 3317 - DNA, 245 bp, Glycine max
ctttcttcctaacacggaacactcaggtttcgaacccttgttgtggttaggtcttcatatttcgaatttgggaattcatgggtcagggaactccgggcggcatgaaccggcagggcgaccggaagccggacggcggcgacaagaaggagaagaagttcgagccggcggcgccgccagcacgcgtggggcggaaacagcggaagcagaagggcccggaggccgcggcgcgactgccgacggtgact

SEQ ID NO: 3318 - DNA, 272 bp, Glycine max
aaacacggggcactggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacagtgactccggtgacgaatgcaaactgcggcttctgaagctg

SEQ ID NO: 3319 - DNA, 292 bp, Glycine max
caaaaatatcatccctctttgttcctaaacacggggcactggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcagcggcgcggttgccgacagtgactccggtgacgaatgcaaactgcggcttctg

SEQ ID NO: 3320 - DNA, 277 bp, Glycine max
ccgcgcaccggattcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacagtgactccggtgacgaactgcaaactgcggcttctgaagctggagcggatc

SEQ ID NO: 3321 - DNA, 275 bp, Glycine max
ggcactggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggaggcggcggcgcggttgccgacagtgactccggtgacgacatgcaaactgcggcttctgaagctggagcggatca

SEQ ID NO: 3322 - DNA, 262 bp, Glycine max
cgggcactggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggaaacagcggaagcagaaaggtccggacgcggcggcgcggttgccgacagtgactccggtgacgacatgcaaactgcggcttctga

SEQ ID NO: 3323 - DNA, 206 bp, Glycine max
tctttgttcctaaacacggggcactggtttcgaaccctcgttgtgactaggtcttcttcacctttcgaattttggaatccatgggtcagggaactccgggcggcatgaaccggcagggcgaccggaagccggacggcggcgacaagaaggagaagaagttcgagccgtcggctccgacggcgcgcgtagggcggaaacagcggaag

SEQ ID NO: 3324 - DNA, 262 bp, Glycine max
ctaaacacggggcactggtttcgaaccctcgttgtggttaggtcttcttcacctttcgaattttggaatccatgggtcagggaactccgggcggcatgaaccggcagggcgaccggaagccggacggcggcgacaagaaggagaagaagttcgagccgtcggctccgccggcgcgcgtggggcggttacagcggaagcagaaaggtccggaggcggcggcgcggttgccgacagtgactccggtgacgagtgcaaactgcgg

SEQ ID NO: 3325 - DNA, 271 bp, Glycine max
caaggtgatagcagcaactaaccgtgcagatattcttgattctgccctgatgcgttctggtcgtttggatcgtaaaattgagtttccacacccaagtgaagaagcaagagctcgaattctacagattcattcaaggaagatgaatgttcacccagatgtcaactttaaagaacttgcccggtccacagatgatttcaatggcgcacaactgaaggctgtctgtgttgaggctggcatgttggctctacgccgtgatgcaactgaggtgaac

SEQ ID NO: 3326 - DNA, 241 bp, Glycine max
tgcgttctggtcgtttggatcgtaaaattgagtttccacacccaagtgaagaagcaagagctcaaattctacagattcattcaaggaagatgaatgttcacccagatgtcaactttgaagaacttgcccggtccacagatgatttcaatggcgcacaactgaaggctgtctgtgttgaggctggcatgttggctctacgccgtgatgcaactgaggtgaaccacgaggattttaatgaagg

SEQ ID NO: 3327 - DNA, 245 bp, Glycine max
cggctcgagcggctcgagctcgagcggtttccacacccaagacaagaagcaagagctcgaactctacagactccattcgaggaacgatgaatgttcacccagatgtcaactttgaagaacttgctcggtccacagatgatttcaatggagctcaactgaaggctgtttgtgttgaggctggcatgttggctctacgccgtgatgcaactgaggtgaaccatgaggactttaatgaaggtattatt

SEQ ID NO: 3328 - DNA, 274 bp, Glycine max
tgagtttccacacccaagtgaagaagcaagagctcgaattctacagatccattcgaggaagatgaatgttcacccagatgtcaactttgaagaacttgctcggtccacagatgatttcaatggagctcaactgaaggctgttgtgttgaggctggcatgttggctctacgccgtgatgcaactgaggtgaaccatgaggactttaatgaaggtattattcaagtccaagcaaagaagaaagcaagcctcaattattatgcataggctggatttt

SEQ ID NO: 3329 - DNA, 277 bp, Glycine max
gtttccacacccaagtgaagaagcaagatctcgaattctacagatccattcgaggaagatgaatgttcacccagatgtcaactttgaagaacttgctcggtccacagatgatttcaatggagctcaactgaaggctgtttgtgatgaggctggcatgttggctctacgccgtgatgcaactgaggtgaaccatgaggactttaatgaaggtattattcaagtccaagcaaagaagatagcaagcctcaattattatgcataggctggattttggaac

SEQ ID NO: 3330 - DNA, 262 bp, Glycine max
gaagaagcaagagctcgaattctacagattcattcaaggcagatgaatgttcacccagatgtcaactttgaagaacttgcccggtccacagatgatttcaatggcgcacaactgaaggctgtctgtgttgaggctggcatgttggctctacgccgtgatgcaactgaggtgaaccacgaggattttaatgaaggtattattcaagtccaagcaaagaagaaagcaagtctgaactattatgcataggctggattgtggaaca

SEQ ID NO: 3331 - DNA, 408 bp, Glycine max
aaattgagtttccacacccaagtgaagaagcaagagctcgaattctacagatccattcgaggaagatgaatgttcacccagatgtcaactttgaagaacttgctcggtccacagatgatttcaatggagctcaactgaaggctgtttgtgttgaggctggcatgttggctctacgccgtgatgcaactgaggtgaaccatgaggactttaatgaaggtattattcatgtccaagcaaagaagaaagcaagcctcaattattatgcataggctggattttggaacaagctatttttcagtttacgaagatctattgagacatatcaagccaatggaaaacctaagtcgatgtttgacatttgttatctatttcttttcttttttttggcaatctaatggtatgataacc

SEQ ID NO: 3332 - DNA, 412 bp, Glycine max
cggctcgagcttgatcctgcccttatgcgttctggtcgattggatcgaaaaattgagttcccacacccaactgaagaagcaagagcccgaattctacagatccattctcggaaaatgaatgttcaccccgatgtcaactttgaagaattagctcggtccacagatgatttcaatgcagcacaacttaaagctgtctgtgttgaggctggcatgttggcccttcgccgtgatgcaactgaggtgaaccatgaggactttaatgaaggcatcatccaagtccaagcaaagaagaaagcaagcttgaattattatgcataggcactcaacgcaaggaaaaacgagcattgaagtttgacttgtttgctagattgatcttactcgaatcatatgtaacatacagcttgctaattta

SEQ ID NO: 3333 - DNA, 261 bp, Glycine max
ctcaaatgacctatacaattactgcccttcgtgggctctttcctggccatatcgcaggcaaaatctgttacgagaaatagttggttaccgtgcagatattatttgtcttcaggaggttcaaagtgatcattatgaagaatttttttctcctgaactggacaaacatggttattatggtctttacaaaaagaaaacaaatgaggtatacaatggaaacattaatacaattgatgggtgtgcaacatttttccgtagagacag

SEQ ID NO: 3334 - DNA, 260 bp, Glycine max
atcgcaggcaaaatctgttacgagaaatagttggttaccgtgcagatattatttgtcttcaggaggttcaaagtgatcattatgaagaatttttttctcctgaactggacaaacatggttattatggtctttacaaaaagaaaacaaatgaggtatacaatggaaacattaatacaattgatgggtgtgcaacatttttccgtagagacagattttcacatgtgaaaaaatatgaggttgaatttaataaggctgcacag

SEQ ID NO: 3335 - DNA, 247 bp, Glycine max
ctttgaagccaccctcttctaacttctccatttcacaaggaagaagatcagagaacatttagaacaaaaaagagagtttgagaaatggggaggggtaagattgagatcaagaggatagagaactcaagcaacaggcaagttacatactcaaagagaaagaatgggatcctaaagaaggccaaggaaatcactgttctatgtgatgctcaagtttcgcttatcatctttgctgcatctggaaagatgc

SEQ ID NO: 3336 - DNA, 253 bp, Glycine max
ctcgagccgaatcggctcgagcctcttctaacttctccatttcacaaggaagaagatcagagaacatttagaacaaaaaagacgagtttgagaaatggggaggggtaagattgagatcaagaggatagagaactcaagcaacaggcaagttacatactcaaagagaaagaatgggatcctaaagaaggccaaggaaatcactgttctatgtgatgctcaagtttcgcttatcatctttgctgcatctggaaag

SEQ ID NO: 3337 - DNA, 390 bp, Glycine max
cttccgttggctttgtcacagtccactgtgcccccaagaaagttccttaacctcaaaccccttatggcaagttgctaacttctcttacttttatctttgaagccaccctcttctaacttctccatttcacaaggaagaagatcagagaacatttagaacaaaaaagagagtttgagaaatggggaggggtaagattgagatcaagaggatagagaactcaagcaacaggcaagttacatactcaaagagaaagaatgggatcctaaagaaggccaaggaaatcactgttctatgtgatgctcaagtttcgcttatcatctttgctgcatctggaaagatgcatgactacatcagccctttctacacgttgattgacatattggagaggta

SEQ ID NO: 3338 - DNA, 257 bp, Glycine max
  unsure (1)..(257): unsure at all n locations
atgagataaaaggtggaaggcctggtccatacatgcaacctcctccctggacgagccagaaccagaaccagngggctccacttgacgtcaatgttgcttatgtggaagggcgggatgctgcggaaagaggagcctctaatcaacctctgacacaggacttcttcatgtcctcggggaagcgganncgtgatgaaattgcttctcaatanntcgctggtgagntatatacctcagcaagatggagctggagatgctga

SEQ ID NO: 3339 - DNA, 249 bp, Glycine max
gtggataactcaatgtataacattcccactggacctagtgactacccgtctgctggaaatgaacctggtgacaataatgagataacaggtggaaggcctggtccatacatgcaacctcctccctggacgagccagaaccagaaccagagggctccacttgacgtcaatgttgcttatgtggaagggcgggatgctgcggaaagaggagcctctaatcaacctctgacacaggacttcttcatgtcctcg

SEQ ID NO: 3340 - DNA, 232 bp, Glycine max
cagaaccagaaccaaagggctccacttgacgtcaatgttgcttacgtggaagggcgggatgaggcggaaagaggagcttcaaatcaacctctgacacaggacttcttcatgtcctcggggaagcggaaacgtgatgaaattgcttctcaatataatgctggtggatatatacctcagcaagatggagctggagatgctgcttctcaaattttggaaattgaagtgtatggag

SEQ ID NO: 3341 - DNA, 238 bp, Glycine max
agcaacctcctccttcaacgtggacgaaccagaaccagaaccaaagggctccacttgacgtcaatgttgcttacgtggaagggcgggatgaggcggaaagaggagcttcaaatcaacctctgacacaggacttcttcatgtcctcggggaagcggaaacgtgatgaaattgcttctcaatataatgctggtggatatatacctcagcaagatggagctggagatgctgcttctcaaat

SEQ ID NO: 3342 - DNA, 276 bp, Glycine max
cctggacctagtgactacccgtctgctggaaatgaacctggtgaacatcatgagatcaaaggtggaaggcctggtccatacatgcaacctcctccctggacgagccacaaccagaaccagagggctccacttgacgtcaatgttgcttatgtggaagggcgggatgctgcggaaagaggagcctctaatcaacctctgacacaggacttcttcatgtcctcggggaagcggaaacgtgatgaaattgcttctcaatataatgctggtggatatata

SEQ ID NO: 3343 - DNA, 439 bp, Glycine max
gataactcaatgtataacattcccactgtacctagtgactacccgtctgctggaaatgagcctggtgcaaataacgagataaaaggtggaaggcctggtccatacatgcaacctcctccttcaacgtggacgaaccagaaccagaaccaaagggctccacttgacgtcaatgttgcttacgtggaagggcgggatgaggcggaaagaggagcttcaaatcaacctctgacacaggacttcttcatgtcctcggggaagcggaaacgtgatgaaattgcttctcaatataatgctggtggatatatacctcagcaagatggagctggagatgctgcttctcaaatttttgaaattgaagtgtatggagggggcatgtccattgatgcaggtcactctacttctaaaggaaaaatgccagcacaatcagacaggccagctt

SEQ ID NO: 3344 - DNA, 252 bp, Glycine max
ggtgttttgagttttgatcaatgagactagccatgtctactccttccaagagcataatctgttcaagtgaagatgattatgaacttagaagagggccatggagtgttgaagaggattatcttctcacccattacattgccaatcatggtgaagggagatggaatttgctagctatacgttcaggactaaggagaacaggtaagagttgcagattgagatggctcaattatctaaagccaaatgttaagagag

SEQ ID NO: 3345 - DNA, 270 bp, Glycine max
gttttgagttttgatcaatgagactagccatgtctactccttccaagagcataatctgttcaagtgaagatgattatgaacttagaagagggccatggagtgttgaagaggattatcttctcacccattacattgccaatcatggtgaagggagatggaatttgctagctatacgttcaggactaaggagaacaggtaagagttgcagattgagatggctcaattatctaaagccaaatgttaagagaggaaatttaacctcggaagagc

SEQ ID NO: 3346 - DNA, 245 bp, Glycine max
tgcaaccctatacaagcagttcacggatgctagtcaacattttcgtgaggctgatacgaataatcgagtgctaaaatcagatgtagaagctttgagagccaaggtgaagttagcggaggatatggtcactaggagctcttttactacgttaaactatcagcttcttcagacacaacaacatcaaatgagcacacccccgcaactgaacacgactaatcttcgccgcatggcgcatgtttcgccaa

SEQ ID NO: 3347 - DNA, 257 bp, Glycine max
agcaagcgcaattgtctgagcttgagttgcaggttgaaaaactcaaagtggaaaatgcaaccctatacaagcagttcacggatgctagtcaacattttcgtgaggctgatacgaataatcgagtgctaaaatcagatgtagaagctttgagagccaaggtgaagttagcggaggatatggtcactaggagctcttttactacgttaaactatcagcttcttcagacacaacaacatcaaatgagcacacccccgcaa

SEQ ID NO: 3348 - DNA, 287 bp, Glycine max
cggttcgagctgaaagtggaaaatgcaaccctatgaaagcagttcacggatgctagccaacattttcgtgaggcagatacgaataaccgagtgctgaaatcagatgtagaagctttgagagccaaggtgaagttagcagaggatatggtgactaggagctcttttactacgttaaacaatcagcttcttcagacacaacatcatcaaatgagcacaccccagcaactgaacacgactaatctgcggcgcatggcgcatgtttcgccaacaatcaccgttcacggaaa

SEQ ID NO: 3349 - DNA, 249 bp, Glycine max
caattgtctgaccttgagttgcaggttgaaaaactgaaagtggaaaatgcaaccctatacaagcagttcacggatgctagccaacattttcgtgaggcagatacgaataaccgagtgctgaaatcagatgtagaagctttgagagccaaggtgaagttagcagaggatatggtgactaggagctctgttactacgttaaacaatcagcttcttcagacacaacatcatcaaatgagcacaccccagcaa

SEQ ID NO: 3350 - DNA, 263 bp, Glycine max
gaggagatgagatcgctctgcaacaatatattcaatctcatgtcgaattacgctaacgttcaagcggacggtggttccgcgggggtggcggcgcggtgcttcggcgaggatgcggtggaggagatgaatccgaagctgtttggggtggtgattggtacgaagcgagcgagagaagagaatgatacggttttgagtctgcatcagccgttccatgcggacgtgaaatccgaagcgttggatttcgcaagacgtggcgaaaataa

SEQ ID NO: 3351 - DNA, 260 bp, Glycine max
gtggaaatggcgctatggcatttgatgtagagtacgcacgatggttagaagagcataatagacaaaccaatgagctaagggctgcaataaattctcatgctggagatattgaacttcgaaccattgttgacaatttcatgacgcagtttgatgatatcttcagactgaaaggtattgcagcaaaagctgatgttttccacattctgtcaggaatgtggaagactccagctgagaggtgtttcatgtggattggaggcttt

SEQ ID NO: 3352 - DNA, 247 bp, Glycine max
ggagatcaggcacagtcaatgagtggaaatggcgctatggcatttgatgtagagtacgcacgatggttagaagagcataatagacaaaccaatgagctaatggctgcaataaattctcatgctggagatattgaacttcgaaccattgttgacaatttcatgacacaatttgatgatatcttcaggctgcaaggtattgcagcaaaaggtgatgttttccacattctgtcaggaaagtggaagactc

SEQ ID NO: 3353 - DNA, 195 bp, Glycine max
tccagggaatatttatttcaagtactggagatcaggcacagtcaatgagtggaaatggcgctatggcatttgatgtagagtacgcacgatggttagaagagcataatagacaaaccaatgagctaagggcctgcaataaattctcatgctggagatattgaacttcgaaccattgttgacaatttcatgacgcag

SEQ ID NO: 3354 - DNA, 268 bp, Glycine max
cgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaaggacaagatcaaggagaatcaggagaagattaagctcaataagcagttgccctacctcgttggcaacattgttgagatattggaaatgaacccggaagac

SEQ ID NO: 3355 - DNA, 294 bp, Glycine max
  unsure (1)..(294): unsure at all n locations
cgcgaacttcgaagatgaccaactagccaatatgaccaccgacgacatcgtcagagcttctcgtcttctacgacaacgagattcgcntcctcaaggaagagttgcagaggaccaatttggaattggaatcgtagaaggacaagatcaaggagaatcaggagaagattaagctcaataagcagttgccctacctcgttggcaacattgttgagatttggnaattnaacccggaagacgaagctgaanaagtngncncnattttgtncttcncncacnnggggggnaatttntttt

SEQ ID NO: 3356 - DNA, 334 bp, Glycine max
caaagttgattctttctctctttatctttctttccccaatttgtgagtgttactgttgaatcgattggattggcattaggttgatctgaaatacgcaattgacatggcgagcgcgatggtagaggacgcgaacttcgaagatgaccaactagccaatatgaccaccgacgacatgtcagagcttctcgtcttctcgacaacgagattcgcatcctcaaggaagagttgcagaggaccaatttggaattggaatcgtacaaggacaagatcaaggagaatcaggagaagattaagctcaataagcagttgccctacctcgttggcaacattgttg

SEQ ID NO: 3357 - DNA, 334 bp, Glycine max
  unsure (1)..(334): unsure at all n locations
gttggttctttctttccccaatttgtgagtgttactattgaatcgattggattgacatggcgagcgcgatggttgaggacgccaacttcgaagatgaccagctcgccaatatgaccaccgacgacgtcgtcagagcttctcgtcttctcgacaacgagattcgcatcctcaaagaagagttgcagaggaccaatttggagttggaatcgtacaaggacaagatcaangagaatcaggagaagataagctcataagcagttgncctactcgttgggaacatcgttgagatattggnatgaaccagaagcganctgagaagnngtgccatatgnct

SEQ ID NO: 3358 - DNA, 236 bp, Glycine max
  unsure (1)..(236): unsure at all n locations
tcgattggattgacatggcgagcgcgatggttgangacgccaacttcgaagatgaccagctcgcnntatgaccaccgacgacgtcgtcagagcttctcgtcttctcgacaacgagancgnatcctcaaagaagagttgcggangaccaatttggagttggaatcgtacaaggacaagatcaaggagaatcaggagaagataagctcaataagcagttgccctacctcgttgggaac

SEQ ID NO: 3359 - DNA, 278 bp, Glycine max
cgattggattggcattaggttgatctgaaatacgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaaggacaagatcaaggagaatcaggagaagattaagctcaataagcagttgccctacctcgttggcaacattgttgagat

SEQ ID NO: 3360 - DNA, 188 bp, Glycine max
gttggttctttctttccccaatttgtgagtgttactattgaatcgattggattgacatggcgagcgcgatggttgaggacgccaacttcgaagatgaccagctcgccaatatgaccaccgacacgtcgtcagagcttctcgtcttctcgacaacgatattcgcatcctcaaagaagagttgcagagga

SEQ ID NO: 3361 - DNA, 237 bp, Glycine max
gattggcattaggttgatctgaaatacgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaaggacaagatcaaggagaatcaggagaagattaagctcaataag

SEQ ID NO: 3362 - DNA, 250 bp, Glycine max
cagctcgccaatatgaccaccgacgacgtcgtcagagcttctcgtcttctcgacaacgagattcgcatcctcaaagaagagttgcagaggaccaatttggagttggaatcgtacaaggacaagatcaaggagaatcaggagaagattaagctcaataagcagttgccctacctcgttgggaacatcgttgagatattggaaatgaaccagaagacgaagctgaagaagatggtgccaatattgatcttga

SEQ ID NO: 3363 - DNA, 253 bp, Glycine max
attggattggcattagggttctctgaaatacgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaaggacaagatcaaggagaatcaggagaagattaagctcaataagcagttgccctac

SEQ ID NO: 3364 - DNA, 259 bp, Glycine max
cgccaatatgaccaccgacgacgtcgtcagagcttctcgtcttctcgacaacgagattcgcatcctcaaagaagagttgcagaggaccaatttggagttggaatcgtacaaggacaagatcaaggagaatcaggagaagattaagctcaataagcagttgccctacctcgttgggaacatcgttgagatattggaaatgaacccagaagacgaagctgaagaagatggtgccaatattgatcttgactcacaaaggaag

SEQ ID NO: 3365 - DNA, 248 bp, Glycine max
  unsure (1)..(248): unsure at all n locations
gttggttctntctttccccaatttgtgagtgttactattgaatcgnttggnttgacatggcgagcgcgatggttgaggacgccaacttcgaagatgaccagctcgccaatatgaccaccgacgacgtcgtcagagcttctcgtcttctcgacaacgagattcgcatcctcaaagaagagttgcgaggancaatttggagttggaatcgtacaaggacaagatcanggagaatcaggagaagattaagc

SEQ ID NO: 3366 - DNA, 295 bp, Glycine max
  unsure (1)..(295): unsure at all n locations
gttgattctttctctctttatctttctttccccaatttgtgagtgttactgttgaatcgattggattggcatnnggttgantctgaaatacgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaagggccagatcaaggagaatcnggagaggntaagcncc

SEQ ID NO: 3367 - DNA, 272 bp, Glycine max
ctcgagctctttctttccccaatttgtgagtgttactgttgaatcgattggattggcattaggttgatctgaaatacgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaaggacaagatcaaggagaatcaggagaag

SEQ ID NO: 3368 - DNA, 277 bp, Glycine max
tacggctgcgagaagacgacagaagggggattggcattaggttgatctgaaatacgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaaggacaagatcaaggagaatcaggagaagattaagctcaataagcagttgccctac

SEQ ID NO: 3369 - DNA, 420 bp, Glycine max
acgcgtcagtacagctgcgagaagacgacagaaggggaacttcgaagatgaccagctcgccaatatgaccaccgacgacgtcgtcagagcttctcgtcttctcgacaacgagattcgcagcctcaaagaagagttgcagaggaccaatttggagttggaatcgtacaaggacaagatcaaggagaatcaggagaagattaagctcaataagcagttgccctacctcgttgggaacatcgttgagatattggaaatgaacccagaagacgaagctgaagaagatggtgccaatattgatcttgactcacaaaggaagggaaagtgtgttgtgctaaagacttctactcgacagaacatccttccaactgttggttgggcttgtggaccctgacaagttaaaacctggtgatctggttggtg

SEQ ID NO: 3370 - DNA, 412 bp, Glycine max
acggctgcgagaagacgacagaaggggactttagtttcgcaaagttgattctttctctctttatctttctttccccaatttgtgagtgttactgttgaatcgattggattggcattaggttgatctgaaatacgcaattgacatggcgagcgcgatggtagaggacgcgaacttcgaagatgaccaactagccaatatgaccaccgacgacatcgtcagagcttctcgtcttctcgacaacgagattcgcatcctcaaggaagagttgcagaggaccaatttggaattggaatcgtacaaggacaagatcaaggagaatcaggagaagattaagctcaataagcagttgccctacctcgttggcaacattgttgagatattggaaatgaacccggaagacgaagctgaagaa

SEQ ID NO: 3371 - DNA, 242 bp, Glycine max
ctttctctctcgctataccaatattaatttgaacctctctcagtacaattccagatagactttgttggcatttgagttttgtcgaatagaaccaaaaagaaaaaatgggaaggcaaccttgctgtgacaaagtggggttgaagaaggggccatggaccgcagaggaggataagaaactcatcaatttcatcctcactaatggccaatgttgctggagagctgtccctaaactagcagggctg

SEQ ID NO: 3372 - DNA, 278 bp, Glycine max
ctaggaactctaagtctccctcccccctctctctttctctcgctctctctctcactatatcaatattaatatgaacctctctcaattcaattccagatagactttgttggcatttgagttttgttgaattgaaccaaaaaaaaaaatgggaaggcaaccttgctgtgacaaagtggggttgaagaaggggccatggactgcagaggaggataagaaactcatcaatttcatcctcactaatggtcaatgttgctggagagctctccctaaactagcag

SEQ ID NO: 3373 - DNA, 275 bp, Glycine max
attcggctcgagtaggaactctaagtctccctcccccctctctctttctctcgctctctctctcactatatcaatattaatatgaacctctctcaattcaattccagatagactttgttggcatttgagttttgttgaattgaaccaaaaaaaaaaatgggaaggcaaccttgctgtgacaaagtggggttgaagaaggggccatggactgcagaggaggataagaaactcatcaatttcatcctcactaatggtcaatcttgctggagagctct

SEQ ID NO: 3374 - DNA, 235 bp, Glycine max
aagctcaagaaggcgacactcgaaagcgcggcgaggcggctagggggaggaaaagaagccatgaagcagttgctgtagctgattcttgagtgggttcaaaccagccatcttcagaataagcgccgaaaggagaataatggtagtagtatgagagatgtacttcaggcacagtttcaggatcctagtggccagaacaacaaccagaatacacaaagtggttcatttgcacctgaat

SEQ ID NO: 3375 - DNA, 258 bp, Glycine max
  unsure (1)..(258): unsure at all n locations
gtctaacaaggatagtgtctcanctaatgacttgaggnatgtgaagctcaagaaggcgacactcgaaagcncggcgaggcggctagggggaggaaaagaagccatgaagcagttgctgaagctgattttgngtgggttcaaaccagccatcttcagaataagcgccgaaaggagaataatggtagtagtattagcagtgtacttcaggcacagtttcaggatcctagtggccagaacaacaaccagaatacacaaagt

SEQ ID NO: 3376 - DNA, 247 bp, Glycine max
gtgacgccgctgtcgaagtgcaagctgcggctgctgaagctggagcgcataaaggactacctcttgatggaggaggagtttgtggcgaaccaggagaggctgaaaccacaggaggagaaggccgaggaagatagatccaaggtcgatgatctcagaggttcccctatgagcgttggtaacctcgaggaactcatcgacgagaatcatgccatcgtttcgtcctcggtggggcccgagtactatgttg

SEQ ID NO: 3377 - DNA, 247 bp, Glycine max
cgtaacagaagggcccggaggcggcggcgcggctgccgacggtgacgccgctgtcgaagtgcaagctaaggctgctgaagctggagcgcataaaggactacctcttgatggaggaggagttcgtggcgaaccaggagaggctgaagccgcaggaggagaaggccgaggaagacagatccaaggtcgatgatctccgaggttctcctatgagcgttggtaacctagaggaactcattgacgagagtca

SEQ ID NO: 3378 - DNA, 245 bp, Glycine max
  unsure (1)..(245): unsure at all n locations
caatcgagccgaatcggctcgagctaactttcgcatattcgaaaaccaaaagcatgggtcagggaacaccggacaacctgcctcggcagcgtcntccgngggaccgggagccggacggcggcgacaagaaggagaagaagtgcgagccggcggcgccgccggcccgcgtgggccgtaagcagcgtaagcaagaagggcccggaggcggcggcgcgcgctgccgacggtgacgccgctgtcgaagt

SEQ ID NO: 3379 - DNA, 425 bp, Glycine max
cttctctaactttcgcatattcgaaaaccaaaagcatgggtcagggaacaccgggcggtctgaaccggcagggtcttccgggggaccggaagccggacggcggcgacaagaaggagaagaagttcgagccggcggcgccgccggcccgcgtgggccgtaagcagcgtaagcagaagggcccggaggcggcggcgcggctgccgacggtgacgccgctgtcgaagtgcaagctaaggctgctgaagctggagcgcataaaggactacctcttgatggaggaggagttcgtggcgaaccaggagaggctgaagccgcaggaggagaaggccgaggaagacagatccaaggtcgatgatctccgaggttctcctatgagcgttggtaacctagaggaactcattgacgagagtcatgccataggttcg

SEQ ID NO: 3380 - DNA, 429 bp, Glycine max
cccacgcgtccgcccacgcgtccgcccacgcgtccgcccacgcgtccgcacgttaaaaaaaaaaaaaaccaaaagcatgggtcagggaacaccgggcggtctgaaccggcagggtcttccgggggaccggaagccggacggcggcgacaagaaggagaaaaagttcgagccggcggccccgccggcccgcgtggggcgtaagcagcggaagcagaaggggccggaggcggcggcgcggctgccgacggtgacgccgctgtcgaagtgcaagctgcggctgctgaagctggagcgcataaaggactacctcttgatggaggaggagtttgtggcgaaccaggagaggctgaaaccacaggaggagaaggccgaggaagatagatccaaggtcgatgatctcagaggttcccctatgagcgttggtaacct

SEQ ID NO: 3381 - DNA, 231 bp, Glycine max
  unsure (1)..(231): unsure at all n locations
tccttcttcttccttatcgcgaaatccgttacttcaaaacctaattgcgtgantntggtttctgatttgtgttgaagcgaagatgaggattatgattaaggncggngtttggaaaaacaccgaagatgaaatcctgaaagcggctgttatgaaatatggtaagaaccagtgggctcgaatctcttcgctccttgttcgcaaatctgccaagcaatgcaaagctcgctggta

SEQ ID NO: 3382 - DNA, 266 bp, Glycine max
gtgacactgtagactctggctcacgccttagacgacgaagctcgctctgtactctcactcacctgaacggatccttcttcttccttatcgcgaattccgttacttcaaaacctaattgcgtgagtgtggtttctgatttgtgttgaagcgaagatgaggattatgattaagggcggtgtttggaaaaacaccgaagatgaaatcctgaaagcggctgttatgaaatatggtaagaaccagtgggctcgaatctcttcgctccttgt

SEQ ID NO: 3383 - DNA, 423 bp, Glycine max
cggctcgacccaagcgtacgtacggctgcgagaagacgacagaagggggataacaaagggtttaagttgggcacgctagacatcgtcttcaatcacggtctaaagtgacactgtagactctggctcacgccttagacgacgaagctcgctctgtactctcactcacctgaacggatccttcttcttccttatcgcgaaatccgttacttcaaaacctaattgcgtgagtgtggtttctgatttgtgttgaagcgaagatgaggattatgattaagggcggtgtttggaaaaacaccgaagatgaaatcctgaaagcggctgttatgaaatatggtaagaaccagtgggctcgaatctcttcgctccttgttcccaaatccgccaggcattgcaaagctcgctggtatgagtggctcgatccct

SEQ ID NO: 3384 - DNA, 266 bp, Glycine max
gcttcagacaaccatgtcactgcagtcatcgcttactgatccacagtctcgttttgagatagggtttagtctgcccacgatatgtgcaaaatatccttatacggatcaattttatggactcttctcagcttatgcacctcaaatttcgggacgtataatgctgccacttaatatgacatctgatgatgaaccaatttacgtaaatgctaagcagtaccatggaatcattagacgtcggcagtcccgtgccaaagctgtacttgatc

SEQ ID NO: 3385 - DNA, 271 bp, Glycine max
  unsure (1)..(271): unsure at all n locations
gcttcagacaaccatgtcactgcagtcatcgcttactgatccacagtctcgttttgagatagggtttagtctgcccacgatatgtgcaaaatatccttatacggatcaattttatggactcttctcagcttatgcacctcaaatttcgggacgtataatgctgccacttaatatgacatctgatgatgaaccaattacgtaaatgctaagcagtaccatggaatcattagacgtcggcagtcccgtgccaaagctgtacttgatcacaant

SEQ ID NO: 3386 - DNA, 245 bp, Glycine max
  unsure (1)..(245): unsure at all n locations
ttctccgacgacttccggcgacgaacaggtactatcctcgaactcatctccgattgctgggaatnatnataatacagtgcaccgtaccacaagttgcaccactgcgcccgagctgctagacgagaatgaaaggcttaggaaagagaacatgcaactgagtaacgagttgagtcaattgaagggtttgtgtaataacatactcgctttgatgaccattatgcttctggttttagcgccagcagtta

SEQ ID NO: 3387 - DNA, 160 bp, Glycine max
cagaacggtgtctccgacgacttccggcgacgaacaggtactatcctcgaactcacctccgattgctgggaataataataatacagtgcaccgtaccacaagttgcaccactgcgcccgagctgctagacgagaatgacaggcttagaaagagaacatgc

SEQ ID NO: 3388 - DNA, 295 bp, Glycine max
gaaaagaaaaacttcacttcacttgcatgccaaatgagaacaacctcttcttagaataatttcctcggtgtttaagccttgtcgatttccgaacaccaatccgagttaattaaacaatgagagtttcgacagaaaagttagagacagagccggagagcaaaaagataaaacgcattcgtggcggcggcggcggggactcgagcaataagcaccctttgtaccgcggcgtgcggatgcggaactgggggaaatgggtgtcggaaatccgcgagccgcggaagaagtcgcggatatg

SEQ ID NO: 3389 - DNA, 258 bp, Glycine max
ggcggattagagaagcagattcaagaattagttgaagccattgttttgcccatgacccacaaggagcggttccaaaagttaggagttcgtcctcccaagggagtgctgttgtatggacctccagggactgggaaaacattgatggctcgtgcctgtgcagcacagacaaatgccacttttctgaaattggctggtcctcaactggtccagatgttcattggagatggagcaaaacttgttcgtgacgccttcaactag

SEQ ID NO: 3390 - DNA, 252 bp, Glycine max
gcagattcaagaattagttgaagccattgttttgcccatgacccacaaggagcggttccaaaagttaggagttcgtcctcccaagggagtgctgttgtatggacctccagggactgggaaaacattgatggctcgtgcctgtgcagcacagacaaatgccacttttctgaaattggctggccctcaactggtccagatgttcattggagatggagcaaaacttgttcgtgacgcctttcaactagcaaaaga

SEQ ID NO: 3391 - DNA, 236 bp, Glycine max
ctttgaaaatggtatccaaaaacccgaacccgcccgagggattctacttggatcctagtggtggcatggctcttccggggaagcctcccttcgcttccgtctccgccgctgccgccgccgcgaactcgtcggaggacgccgccaagaagatccgcaagcccgacaccatcacaaagtcaagggagaatgggaccgaacccgaacacgacaagtcctcgaagcaattcaatgtttga

SEQ ID NO: 3392 - DNA, 228 bp, Glycine max
ctggggttaaagaacatgtcaaaatggagtaactgaagcaacccctaaaagattcatatctcgttttcctttttaaggaacatttgtgggttacagcaaaatatgtagataaacgtgtctgacacattacatttttcgaatttgattcgtgtattctaatgtttccatcctttgaaccgagttgttcctaagattcataatcgtaccatgtttctttttaatgagatg

SEQ ID NO: 3393 - DNA, 228 bp, Glycine max
ctggggttaaagaacatgtcaaaatggagtaactgaagcaacccctaaaagattcacttctcgttttcctttttaaggaacatttgtgggttacagcaaaatatgtagataaacgtgctgacatcattacatttttcgaatttgattcgtgtattctaatgtttccatcctttgaaccgagttgttcctaagattcataatcgtaccatgtttctttttaatgagatg

SEQ ID NO: 3394 - DNA, 252 bp, Glycine max
ctggggttaaagaacatgtcaaaatggagtaactgaagcaacccctaaaagattcacttctcgttttcctttttaaggaacatttgtgggttacagcaaaatatgtagataaacgtgtctgacatcattacattgttcgaatttgattcgtgtattctaatgtttccatcctttgaaccgagttgttcctaagattcataatcgtaccatgtttctttttaatgagatgaaaaaaaagaaaaaaaggggggg

SEQ ID NO: 3395 - DNA, 259 bp, Glycine max
gttggcgtctatgacgaccgacgacgtcgtcagagactcagagcctctcgtatgctcgaaaacggcattcgcattctcaaggaagaggtgcagagatcgaatcgggaatgggaatcatacaaggagaagataaaaaataacgaggagaaggttaaacttcataagcagttgccctacctcgttgctaacattgttgagatattggatatgaatccagaagatgaagctgaagaagatggggccaacattgatcttgact

SEQ ID NO: 3396 - DNA, 265 bp, Glycine max
  unsure (1)..(265): unsure at all n locations
tgaaccccattttccattggcaattgnagtgatggcgagcgccatgttagttggcgtctatgaccaccgacgacgtcgtncagagactcagagcctctcgtatgctcgaaaacggcattcgnattctcaaggaagaggtgcagagatcgaatcgggaatgggaatcatacaaggagaagataaaaaataacgaggagaaggttaaacttcataagcagttgccctacctcgttgctaacattgttgagatattggatatgaatcc

SEQ ID NO: 3397 - DNA, 254 bp, Glycine max
catgaactcgtctccgtcttcttcccagttaccttcatcaagcgctgattttgacaagtttaatagtttgccgcgcttccgcccacttgaatgcttgcaagggaacccggttccggcgttcctgtccaagactttcgaactcgtcgacgatccctcgctggatccgatcatatcctggggctccaccggtgttagcttcgtggtgtgggatcctacctgtttgcaagacactcttgccgaggatttcaagcaaa

SEQ ID NO: 3398 - DNA, 265 bp, Glycine max
aaaggataatagcttttgacctagctaatagcacacaataatgggaagatccccatgctgcgatgagaatggccttaagaaaggtccctggactcccgaagaagatcagaaactagtccaacacattcagaaacatggccatggaagttggagagccctccctaagttagctggtctcaatagatgtggaaaaagttgtaggctaaggtggactaactatttaaggcctgatatcaagagggggaattttctcaagaagaggagc

SEQ ID NO: 3399 - DNA, 287 bp, Glycine max
ggataatagcttttgacctagctaatagcacacaataatgggaagatccccatgctgcgatgagaatggccttaagaaaggtccctggactcccgaagaagatcagaaactagtccaacacattcagaaacatggccatggaagttggagagccctccctaagttagctggtctcaatagatgtggaaaaagttgtaggctaaggtggactaactatttaaggcctgatatcaagagggggaagttttctcaagaagaggagcaaacaattctgcatctccattcca

SEQ ID NO: 3400 - DNA, 261 bp, Glycine max
attaaaacggtaaaacgaacacacccttgttacttggacgtggaaattcacgttcgcgctcctttttatcttggcattgcgtttgtgtgtgtgtgcaatatcacacaacccaaccttattcgttcttctgttgttctgaggcgagccatgacggacggtcatctcttcaacaacatcaccctcggtggccgtggaggcaccaatccagggcagataaaaatatatcctggaggaattgtatggaagagacagggtggtggt

SEQ ID NO: 3401 - DNA, 272 bp, Glycine max
ctcgtgcatttttacggcttcctaaatctgtgggtgtggattttcgtgcctcgtgtttctgccataaacaaacaattgacatgggctatgtgtgttctgtatgcttattcatattctgtgagcaccatgataagtgttcaacctgtgggggttatcatgtcaagaaaagctatgagatgaaggcaatcccagctgattaagatgaagttttcagtcctgtatttggataatctcttgataacatctacacagccgcaacatttccatgagca

SEQ ID NO: 3402 - DNA, 281 bp, Glycine max
ttacaagcctccccaattggacgggctttatcaatatctttcaacagtgtttgcaactgatttgcattctcgtgcatttttacggcttcctaaatctgtgggtgtggattttcgtgcctcgtgtttctgccataaacaaacaattgacatgggctatgtgtgttctgtatgcttatccatattctgtgagcaccatgataagtgttcaacctgtgggggttagcatgtcaagaaaagctatgagatgaaggcaatcccagctgattaagatgaagttttca

SEQ ID NO: 3403 - DNA, 272 bp, Glycine max
acggctgcgagacgacagaaggggatgcataagaacaagcacaaggtctgattcgtgtttccttacatcaacttgtggtctaaaaatgggaaggatgccatgctgtgagaaggtagggttgaacaaaggaccatggaaaaccgaagaagatgagaagctcgtggcttatgttgaaaggcatggggctggaaactggcgttcagtgcctgccaaagcgggtcttcaaagatgtggcaagagttgtagactgaggtggatcacttactaaaccc

SEQ ID NO: 3404 - DNA, 264 bp, Glycine max
tacggctgcgagaagacgacagaagggggcataagaacaagcacaaggtctgattcgtgtttccttacatcaacttgtggtctaaaaatgggaaggatgccatgctgtgagaaggtagggttgaacaaaggaccatggaaaaccgaagaagatgagaagctcgtggcttatgttgaaaggcatggccctggaaactggcgttcagtgcctgccaaagcgggtcttcaaagatgtggcaagagttgtagactgaggtggatcaac

SEQ ID NO: 3405 - DNA, 261 bp, Glycine max
cggctcgagtacggctgcgagaagacgacagaaggggatgcataagaacaagcacaaggtctgattcgtgtttccttacatcaacttgtggtctaaaaatgggaaggatgccatgctgtgagaaggtagggttgaacaaaggaccatggaaaaccgaagaagatgagaagctcgtggcttagttgcaggcatggccctggaaactggcgttcagtgcctgccaaagcgggtcttcaaagatgtggcaagagttgtagactg

SEQ ID NO: 3406 - DNA, 256 bp, Glycine max
tactcgagcgaatcggctcgagtacggctgcgagaagacgacagacggggatgcataagaacaagcataaggtctgattcgcgtttccttacatcaacttgtggtctaaaaatgggaaggatgccatgctgtgagaaggtagggttgaacaaaggaccatggaaaaccgaagaagatgagaagctcgtggcttatgttgaaaggcatggccctggaaactggcgttcagtgcctgccaaagcgggtcttcaaagat

SEQ ID NO: 3407 - DNA, 272 bp, Glycine max
tacggctgcgagaagacgacagaaggggacatgcataagaacaagcacaaggtctgattcgtgtttccttacatcaacttgtggtctaaaaatgggaaggatgccatgctgtgagaacgtagggttgaacaaaggaccatggaaaaccgaagaagatgagaagctcgtggcttatgttgaaaggcatggccctggaaactggcgttcagtgcctgccaaagcgggtcttcaaagatgtggcaagagttgtagactgaggtggatcaactacc

SEQ ID NO: 3408 - DNA, 262 bp, Glycine max
tacgagaagacgacagaaggggatgcataagaacaagcacaaggtctgattcgtgtttccttacatcaacttgtggtctaaaaatgggaaggatgccatgctgtgagaaggtagggttgaacaaaggaccatggaaaaccgaagaagatgagaagctcgtggcttatgttgaaaggcatggccctggaaactggcgttcagtgcctgccaaagcgggtcttcaaagatgtggcaagagttgtagactgaggtggatcaacta

SEQ ID NO: 3409 - DNA, 233 bp, Glycine max
gacatgcataagaacaagcacaaggtctgattcgtgtttccttacatcaacttgtggtctaaaaatgggaaggatgccatgctgtgagaaggtagggttgaacaaaggaccatggaaaaccgaagaagatgagaagctcgtggcttatgttgaatggcatggccctggaaactggcgttcagtgcctgccaaagcgggtcttcaaagatgtggcaagagttgtagactgaggt

SEQ ID NO: 3410 - DNA, 274 bp, Glycine max
acggctgcgagaagacgacagaaggggatgcataagagcaagcacaaggtctgattcgtgtttccttacatcaacttgtggtctaaaaatgggaaggatgccatgctgtgagaaggtagggttgaacaaaggaccatggaaaaccgaagaagatgagaagctcgtggcttatgttgaaaggcatggccctggaaactggcgttcagtgcctgccaaagcgggtcttcaaagatgtggcaagagttgtagactgaggtggatcaactacctaaac

SEQ ID NO: 3411 - DNA, 300 bp, Glycine max
gtcagtattcggctcgagtaggatgcgagaagacgacagaaggggatgcataagagcaagcacaaggtctgattcgtgtttccttacatcaacttgtggtctaaaaatgggaaggatgccatgctgtgagaaggtagggttgaacaaaggaccatggaaaaccgaagaagatgagaagctcgtggcttatgttgaaaggcatggccctggaaactggcgttcagtgcctgccacagcgggtcttcaaagatgtggcaagagttgtagactgaggtggatcagctacctaaaccctaatat

SEQ ID NO: 3412 - DNA, 238 bp, Glycine max
tagaagcagggttgatcccaattccggggtacagtagtggtaccaccacaacctcacccttcaccttggattgggtgaacactagtcctgcttatgatgatggcttcaaaggaatcactgctaagagatcctcctctggaagaccccttgagcaggaaaggaagaaaggtgtgccatggactgaagaggaacataagttgtttctactggggctgaagaagtatggcaaaggtgattg

SEQ ID NO: 3413 - DNA, 284 bp, Glycine max
ctcacccttcaccttggattgggttaatcctgcctatggtgatggcttcaaaggactcactgctaagagatcctcctctggcagacctcctgagcaggaaaggaagaaaggtgtgccatggactgaagaagaacacaagttgtttcttctggggctgaagaagtatgtcaaaggtgattggaggaacatatcgcgcaattatgtgatcactcggacgccaactcaagttgctagccatgctcagaagtacttcataaggcaactatcaggaggcaaggacaaga

SEQ ID NO: 3414 - DNA, 274 bp, Glycine max
ggcttcaaaggaatcactgctaagagatcctcctctggaagaccccttgagcaggaaaggaagaaaggtgtgccatggactgaagaggaacataagtagtttctactggggctgaagaagtatggcaaaggtgattggagaaacatatcgcgaaattatgtgatcactaggacgccaactcaagatgctagccatgctcagaagtacttcatcaggcaactatcaggaggcaaggacaagaggagggctagcatccatgacataacaacggtta

SEQ ID NO: 3415 - DNA, 426 bp, Glycine max
aatcttcttcattacatggcttcttcagatcccatctcttctcgccactacacttacaacagaaaacaaaaatctctaggccttctctgcactaatttcttgagcttgtacaaccgagacaccgttcacttgattggcctagacgatgctgccacccgattaggtgttgagagacggcggatctatgacattgtgaatgtcctggagagtatcggtgtactctcaaggaaagcaaaaaatcaatacacatggagagggtttgccgcaatccctctcactctacaggatctcaaggaagaggggttgaaggagaattctaattccctacgtgggcctggaaaccatgataaagtttccgacgacgaagatgacgaggaaacacagtccaatccccgcgctactggaagtcaaagtgacaagttgaac

SEQ ID NO: 3416 - DNA, 290 bp, Glycine max
cagatgatggcatcatttgcagggactactcagaagtgcaaagcatgtgagaagactgtgtatttggtggatcagctcactgctgacaacaagatctatcacaaatcatgtttcagatgctaccactgcaagggtacccttaagttgagtaattattgttcctttgagggtgttttatactgtaagcctcattttgatcaactctttaagaagactggcagcttggacaaaagttttgaaggtattccaagaactgcaagacttgaaagatctgccgatcaggtccaaac

SEQ ID NO: 3417 - DNA, 291 bp, Glycine max
cattgttcaacttgagatgatggcatcatttgcagggactactcagaagtgcaaagcatgtgagaagactgtgtatttggtggatcagctcactgctgacaacaagatctatcacaaatcatgtttcagatgctaccactgcaagggtacccttaagttgagtaattattgttcctttgagggtgttttatactgtaagcctcattttgatcaactctttaagaagactggcagcttggacaaaagttttgaaggtattccaagaactgcaagacttgaaagatctgccga

SEQ ID NO: 3418 - DNA, 277 bp, Glycine max
gaagtgttctcctaattcagtgagtgaggttctgaattctttaacttgagatgatggcatcatttgcagggactactcagaagtgcaaagcatgtgagaagactgtgtatttggtggatcagctcactgctgacaacaagatctatcacaaatcatgtttcagatgctaccactgcaagggtacccttaagttgagtaactattgttcctttgagggtgtgttatactgtaagcctcattttgatcaactctttaagaagactggcagcttggacaa

SEQ ID NO: 3419 - DNA, 266 bp, Glycine max
ctcgagccgaatcggctcgagacggctgcgagaagacgacagaaagggttgcaaaaaggaacggaaacagactctctgatgcgcactgggagcttaggaacttcagtgctaatcttgttacttcaatatgccaaagatttgggcatatttatcacaatctgcagccacgtgtgatgaagacatttcttcattctttcttggaccctacaaaagctttgcctcaacactatggtgcaattaaagggatagaagctcttggatcaaga

SEQ ID NO: 3420 - DNA, 259 bp, Glycine max
aaacagactctctgatgagcactgggagcttaggaacttcagtgctaatcttgttacttcaatatgccaaagatttgggcatatttatcacaatctgcagccacgtgtgatgaagacatttcttcattctttcttggaccctacaaaagctttgcctcaacactatggtgcaattaaagggatagaagctcttggatcaagactgattcgcttgcttatacttccaaatctcgagccatatttgcatcttcttgagcca

SEQ ID NO: 3421 - DNA, 247 bp, Glycine max
aagatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaagg

SEQ ID NO: 3422 - DNA, 257 bp, Glycine max
ctttacacaacatattattgtaaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagc

SEQ ID NO: 3423 - DNA, 252 bp, Glycine max
ctttacacaacatattattgtaaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacagga

SEQ ID NO: 3424 - DNA, 299 bp, Glycine max
agaggatgggtagacgatcctgctgccctatagagatcaacaaaggtgcttggtctcgagaagaagatgaaaccctctccaaatatgtttccatccatggagaaggaaaatggcagaaggttgcccaaaatgcagggttaaagcgatgtggaaagagttgcagacaaagatggttgaattatctcaagcccggtataaaaagaggccacatctctgtggatgaagaggatatgattataagacttcatcgtcttcttggtaacagatgggcattgattgcaaagaggctacctggacga

SEQ ID NO: 3425 - DNA, 273 bp, Glycine max
cgaggatgggtagacgaccctgctgccccatagatatcaacaaaggtgcttggtctcgagaagaagatgaaaccctctccaaatatgtttccatccatggagaaggaaaatggcagaaggttgcccaaaatgcagggttaaagcgatgtggaaagagttgcagacaaagatggttgaattatctcaagcccggtataaaaagaggccacatctctgtggatgaagaggatatgattataagacttcatcgtcttcttggtaacagatgggcat

SEQ ID NO: 3426 - DNA, 263 bp, Glycine max
agacgaccctgctgccccaaagagatcaacaaaggtgcttggtctcgagaagaagatgaaaccctctccaaatatgtttccatccatggagaaggaaaatggcagaaggttgcccaaaatgcagggttaaagcgatgtggaaagagttgcagacaaagatggttgaattatctcaagcccggtataaaaagaggccacatctctgtggatgaagaggatatgattataagacttcatcgtcttcttggtaacagatgggcatg

SEQ ID NO: 3427 - DNA, 265 bp, Glycine max
cggctcgaggattatttgtttgtttcagtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactagaagatcgacagtcgtggtatcgtgactgtcgatg

SEQ ID NO: 3428 - DNA, 268 bp, Glycine max
cggctcgaggattatttgtttgtttcagtcttctcgccatagctgaggagaccctggcagaattcctttccaaggctactggaactgctgtcgactgggtccagatgattgggatgaagcctggtccggattctattggaatcgttgctgtttcccgcaactgtagtggcgtggcagcacgagcctgcggtcttatgagcctagagcccactaaggttgctgagatactaaacgatcgacagtcgtggtatcgtgactgtcgatgcgt

SEQ ID NO: 3429 - DNA, 203 bp, Glycine max
gaagaaggcgctgccggcgaacgcgaagatctcgaaggacgcgaaggagacggtgcaggagtgcgtgtcagagttcatcagcttcatcaccggcgaggcctccgacacgtgccagcgcgagaagcgcaagacgatcaacggcgacgacctgctctgggcgatgaccactctgggcttcgaggactacgtggagcctcctcaaa

SEQ ID NO: 3430 - DNA, 244 bp, Glycine max
aggcgcgtccttgtcacgcgccgccacggtcttctctccttccatttctcggaagcgctggaggtagcctttgagaggctccacgtagtcctcgaagcccagagtggtcatcgcccagagcaggtcgtcgccgttgatcgtcttgcgcttctcgcgctggcacttgtcggaggcctcgccggtgatgaagctgatgaactctgacacgcactcctgcaccgtctccttcgcgtccttcgagatc

SEQ ID NO: 3431 - DNA, 352 bp, Glycine max
  unsure (1)..(352): unsure at all n locations
gagaaatacctgttatatgcaatgcctatgcttcagagtgccgcagagctntctgctcatacatctggtgctgatgacgatatgacagaatacactaattctttgagaaatggaattctagaggcatactcagggatcttccaagggtttaaaggttccccaaagacccagcttctgatgccatatgctcctcatgtgctgcaattcttggatagtttgtataatgagaaggacatggatgatgttgtgactaagacagcaattggcgtgcttggagatttagctgatactttgggtagtaacgctggcccgttgattcagcaatctgtgtccagcaaagacttccttaaag

SEQ ID NO: 3432 - DNA, 314 bp, Glycine max
tccgttaagcctcctattttttcatgttttggagacattgccttggcaattggagaaaactttgagaaatacctgttatatgcaatgcctatgcttcagagtgccgcagagctctctgctcatacatctggtgctgatgacgatagacagaatacactaattctttgagaaatggaattctagaggcatactcagggatcttccaagggtttaaaggttccccaaagacccagcttctgatgccatatgctcctcatgtgctgcaatcttggatagtttgtataatgagaagacatggatgatgttgtgataag

SEQ ID NO: 3433 - DNA, 226 bp, Glycine max
gagtgccgcagagctctctgctcatacatctggtgctgatgacgatatgacagaatacactaattctttgagaaatggaattctagaggcatactcagggatcttccaagggtttaaaggttccccaaagacccagcttctgatgccatatgctcctcatgtgctgcaattcttggatagtttgtataatgagaaggacatggatgatgttgtgactaagacagca

SEQ ID NO: 3434 - DNA, 257 bp, Glycine max
gttaagcctcctattttttcatgttttggagacatagccttggcaattggagaaaactttgagaagtacttgttatatgcaatgcctatgcttcagagtgctgcagaactctctgctcatacatctggtgctgatgatgatatgacagaatacacaaattctttgagaaatggaattctagaggcatactcagggatcttccaaggatttaaaggttccccaaagacccagcttctgatgtcttatgctcctcatgt

SEQ ID NO: 3435 - DNA, 302 bp, Glycine max
aaccactcttcctctcctccaaattaaaacacttatcatggatgttaagaaaggtgggtctgtagtacaagcacaagtgaagttgcagaagcataacgaaaaggagatgggcatgagaaaaggtccatgggcggttgaggaggacaccattctggtcaattacatcgccacacacggtgaaggccactggaattccgtggcacgatgtgcaggtctaaggaggagtgggaagagttgcagattaaggtggctaaactacttgcgcccagacgtgcggcgtggaaatatcacactccaagaac

SEQ ID NO: 3436 - DNA, 417 bp, Glycine max
  unsure (1)..(417): unsure at all n locations
cccactcgtccgtacggctgcgagaagacgacagaaggggaagtgaaaccatcaatcccctgtatatataaccactcttcctctcctccaaattaaaacacttatcatggatgttaagaaaggtgggtctgtagtacaagcacaagtgaagttgcagaagcataacgaaaaggagatgggcatgagaaaaggtccatgggcggttgaggaggacaccattctggtcaattacatcgccacacacggtgaaggccactggaattccgtggcacgatgtgcaggcatgcatgcatcttaattataatttaatttctgcatgtgccaagtaataatggtatatatgttaattatgagatttatcaattacaggtctaaagaggagtgngaagagttgcagattaaggtggctaaactact

SEQ ID NO: 3437 - DNA, 264 bp, Glycine max
ggctttgtggcaaatgaggaaaccttatatgatggaaaaagacaaaatgaacaacaacattaagagcaagctaaggaagggattgtggtcacctgaggaagatgaaaaactcctaaggtacatgatcactaagggacaagggtgttggagtgacattgctaggaatgctggccttcaaaggtgcggcaagagttgccggcttcgttggattaactacttgagacctgatctcaaacgtggtgcattttcaccccaagaggaaga

SEQ ID NO: 3438 - DNA, 303 bp, Glycine max
  unsure (1)..(303): unsure at all n locations
ggtgagggagcccaacaagaagaccaggatttggctggggactttccccacgccgganatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggc

SEQ ID NO: 3439 - DNA, 284 bp, Glycine max
ggaagaagcacttgctgaagaacatccaaaggcgcaggtcatctcaatcccagcaggttggtagctatattggaatcgaatgttctactgaggcaggaaggtctgatgttgagattgagatagaaaggcttaggaaagaaaggactatgttgatggaagaggttgttgatttgaaacaagagcagcgaagaatggctcaccgcgcaggagaagtgaatcaaaggctacaatccagaacaaaggcagaaacaaatggtttctttcctggtcaagttaatccagaa

SEQ ID NO: 3440 - DNA, 267 bp, Glycine max
ctcgagccgctcgagccgattcattctcaggtaacttggtgtttgtcttcagggattccgcaagattgacacagacaagtgggagtttttcaacgaagctttccagcgagggaagaagcacttgctgaagaacatccaaaggcgcaggtcatctcaatcccagccggttggtagctatattggaatcggatcttctaccgaggcaggggggtcagaggttgagattgagatagaaaggcttaggaaagaaaagactatgctgatgga

SEQ ID NO: 3441 - DNA, 270 bp, Glycine max
tatggattccgcaagattgacacggacaagtgggagtttttcaacgaagctttccagcgagggaagaagcacttgctgaagaacatccaaaggcgcaggtcatctcaatcccagcaggttggtagctatattggaatcgatgttctactgaggcaggaaggtctgatgttgagattgagatagaaaggcttaggtaagaaaggactatgttgatggaagaggttgttgatttgaaacaagagcagcgaagaatggctcaccgcgcaggag

SEQ ID NO: 3442 - DNA, 253 bp, Glycine max
ctaagatagatctcgagatgggtcgtggcaagattgagataaagttgattgagaaccccaccaacaggcaagtcacctactccaagcgaaggaatggtatcttcaagaaagctcatgaactcagtgttctctgtgatgccaaggtttcactcatcatgttctctaaaaacaacaagatgcatgaatacattagccctggcctcacgacaaaaaagatcattgatcagtatcagaagactttgggggatattga

SEQ ID NO: 3443 - DNA, 259 bp, Glycine max
tacggctgcgagaagacgacagaaggggatccatagctaagatagatctcgagatgggtcgtggcaagattgagataaagttgattgagaaccccaccaacaggcaagtcacctactccaagcgaaggaatggtatcttcaagaaagctcatgaactcagtgttctctgtgatgccaaggtttcactcatcatgttctctaaaaacaacaagatgcatgaatacattagccctggcctcacgacaaaaaagatcattga

SEQ ID NO: 3444 - DNA, 293 bp, Glycine max
gaagatccatagctaataagctaggttcagtagttagtgagtgatcgatatctggagatgggtcgaggcaagattgagataaagttgattgagaaccccaccaacaggcaagtcacttactccaagcgaaggaatggtatcttcaagaaagctcatgaactcagtgttctctgtgatgccaaggtttcacttatcatgttctctaaaaacaacaagatgcatgaattaattagccctggcctcacgacaaaaaggatcattgatcagtatcagaagactttgggggatattga

SEQ ID NO: 3445 - DNA, 265 bp, Glycine max
gaagatccatagctaataagctaggttcagtagttagtgagtgatcgatatctggagatgggtcgaggcaagattgagataaagttgattgagaaccccaccaacaggcaagtcacttactccaagcgaaggaatggtatcttcaagaaagctcatgaactcagtgttctctgtgatgccaaggtttcacttatcatgttctctaaaaacaacaagatgcatgaatacattagccctggcctcacgacaaaaaggatcattgatc

SEQ ID NO: 3446 - DNA, 422 bp, Glycine max
ccaagcgtcaccgagcgtccgtacggctgcgagaagacgacagaaggggactgcactcttattaataaatatcagtgcttggaaagcaaaagagaagatccatagctaagatagatctcgagatgggtcgtggcaagattgagataaagttgattgagaaccccaccaacaggcaagtcacctactccaagcgaaggaatggtatcttcaagaaagctcatgaactcagtgttctctgtgatgccaaggtttcactcatcatgttctctaaaaacaacaagatgcatgaatacattagccctggcctcacgacaaaaaagatcattgatcagtatcagaagactttgggggatattgatctgtggcattctcactatgagaaaatgcttgaaaacttgaagaagctgaaagatattaacaat

SEQ ID NO: 3447 - DNA, 365 bp, Glycine max
atagctaataagctaggttcagtagttagtgagtgatcgatatctggagatgggtcgaggcaagattgagataaagttgattgagaaccccaccaacaggcaagtcacttactccaagcgaaggaatggtatcttcaagaaagctcatgaactcagtgttctctgtgatgccaaggtttcacttatcatgttctctaaaaacaacaagatgcatgaatacattagccctggcctcacgacaaaaaggatcattgatcagtatcagaagactttgggggatattgatctgtggcgttctcactatgagaaaatgcttgaaaacttgaagaagctgatagatattaacaacaagctcagaagacaga

SEQ ID NO: 3448 - DNA, 282 bp, Glycine max
ctcttctctctcttcgccgttggtttcactcagctctcactctcatccccatcccaaaccctagcctcgctatttttcatgattcctctcgatctcttccactgaactctctctcaaatcggtcgtatacggagaattatcggagacactcggaggtctgctaaaattaacattcgcgatggcggcttccactaccagccaggtctacatcgatgtaatcgaggatgtcatggtcaaggtccgtgacgagttcgtgaacaacggtggtcctggagaggaagt

SEQ ID NO: 3449 - DNA, 266 bp, Glycine max
aaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaagg

SEQ ID NO: 3450 - DNA, 275 bp, Glycine max
ccaaccttaaagcttgaaactttcactaagcagagaagcatggtgtcaaaaaatccgaacccctctgaggctttttacttggacccctccggcatgtcgctccccggaatccttcccttcgccgccgcagccaccgccaccgcagattcctttgaggaccctgctaagaagactcgcaagccttacactattaccaagtctagggagagttggaccgaacctgagcacgacaagttcctcgaagctcttcagttatttgacgtgatggaaaaaga

SEQ ID NO: 3451 - DNA, 255 bp, Glycine max
cttaaagcttgaaactttcactaagcagagaagcatggtgtcaaaaaatccgaacccctctgaggctttttacttggacccctccggcatgtcgctccccggaatccttcccttcgccgccgcagccaccgccaccgcagattcctttgaggaccctgctaagaagactcgcaagccttacactattaccaagtctagggagagttggaccgaacctgagcacgacaagttcctcgaagctcttcagttatttga

SEQ ID NO: 3452 - DNA, 280 bp, Glycine max
cggctgcgagaagacgacagaaggggagattaaaagcaagggtagaagtattgcaacgttctcaaaggaacctactcggggaagatcttgcccaaatgaatacaaatgagctagagcagcttgagaatcaactggaggcagcactgaggaatattatgtcaacaaagactcaattcatgcttgaccagctttctgatcttcaccaccgggaaacattgcttattgaaactaataacgtgttaaggagtaagttggaagaaactgatcactcacaagttca

SEQ ID NO: 3453 - DNA, 277 bp, Glycine max
cggctgcgagaagacgacagaaggggagattaaaagcaagggtagaagttttgcaacgttctcaaaggaacctactcggggaagatcttgcccaaatgaatacaaatgagctagagcagcttgagaatcaactggaggcagcactgaggaatattaggtcaacaaagactcaattcatgcttgaccagctttctgatcttcaccaccgggaaacattgcttattgatactaataacgtgttatggagtaagttggcagaaactgatcactcacgagt

SEQ ID NO: 3454 - DNA, 267 bp, Glycine max
cagatgcgaactggccaagacattgcttgcgaaggctgtggcaaactcaacatcagcaacattgttgcgtgttgttggtagtgaactgatacaaaagtacttgggagatggcccaaaacttgtaagagaacttttcagagttgctgatgatctttctccttctattgtattcattgatgaaattgatgcagttggtacaaaaaggtatgatgctcactcaggaggagaacgtgaaattcaaaggaccatgctagagctgctgaacca

SEQ ID NO: 3455 - DNA, 266 bp, Glycine max
ggagaacctggaactgggaagacattgcttgcgaaggctgtggcaaactcaacatcagcaacattcttgcgtgttgttggtagtgaactgatacaaaagtacttgggagatggcccaaaacttgtaagagaacttttcagagttgctgatgatctttctccttctattgtattcattgatgaaattgatgcagttggtacaaaaaggtatgatgctcactcaggaggagaacgtgaaattcaaaggaccatgctagagttgctgaa

SEQ ID NO: 3456 - DNA, 271 bp, Glycine max
tctcgagccgaatcggctcgagatttgcgccaccagtaatgttgagagcccaatctcggcacataaaccagagggcagagacgaatcgtaccaaaggagccacgagtggttcctctgagccgtctgatgaggatgatgaagcaggtgcttgtgaacagagcacaaatccagctgatatgaagcgccttagaaggaaggtttctaatcgcgactctgctagaaggtcaagaagaagaaagcaagcgcaattgtctgagcttgagttgcagga

SEQ ID NO: 3457 - DNA, 263 bp, Glycine max
actcgagccgaatcggctcgagatttgcgccaccagtaatgttgggagcccaatctcggcaaataaaccagagggcagagagacatcgtaccaaaggagccacgagtggttcctctgagccgtctgatgaggatgatgaagcaggtgcttgtgaacagagcacaaatccagctgatatgaagcgccttagaaggaaggtttctaatcgcgactctgctagaaggtcaagaagaagaaagcaagcgcaattgtctgagcttgag

SEQ ID NO: 3458 - DNA, 169 bp, Glycine max
gagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgcca

SEQ ID NO: 3459 - DNA, 207 bp, Glycine max
cgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgacaaagagcacatgcaggaatgcgtttctgagttcatcagcttcattacaagcgaggcaattgaga

SEQ ID NO: 3460 - DNA, 254 bp, Glycine max
  unsure (1)..(254): unsure at all n locations
aggaagtggtatgaaactgaaaagaattttgctgatgagaagcctgcaggcgaggaagatgcacctgaaggaaacaangactgtcctgccaatgaaaatgaagaaaaggagcctgaggacaaggagatgacactggaagagtatgagaaggtgctggaagagaaaagaaaggccctgcaggcacaaaaaactgaagtaagaaaggtggacatcaaggagtttgcatccatgcagccactgtctaacaagaaaga

SEQ ID NO: 3461 - DNA, 270 bp, Glycine max
ggaagagaaaaggaaggccctgcaggctcaaaaaactgaagcaagaaaggtggacatcaaggaatttgcatccatgcagccactgtcaaacaagaaagaaaatgatgagatctttattaaattgggatctgacaaggataagcgcaaagatgctttggagaaggaggagaaatccaagaagtctgtcaacatcactgagtttctgaagccagctgaaggggaaaggtactaccctggtgggcgtggtcggggacgtggccgtggttctag

SEQ ID NO: 3462 - DNA, 263 bp, Glycine max
cgagaagacgacagaagggaacaaggactgtcctgccaatgaaaatgaagaaaaggagcctgaggacaaggagatgacactggaagagtatgagaaggtgctggaagagaaaagaaaggccctgcaggcacaaaaaactgaagtaagaaaggtggacatcaaggagtttgcatccatgcagccactgtctaacaagaaagaaaatgatgagatctttattaaattgggatctgacaaggataaacgcaaagatgttctagaga

SEQ ID NO: 3463 - DNA, 336 bp, Glycine max
aaggaaacatggacagtcctgctaatgaaaatgaagaaaaggagcctgaggacaaggagatgacactggaagagtatgagaaggtgctggaagagaaaaggaaggccctgcaggctcaaaaaactgaagcaagaaaggtggacatcaaggaatttgcatccatgcagccactgtcaaacaagaaagaaaatgatgagatctttattaaattgggatctgacaaggataagcgcaaagatgctttggagaaggaggagaaatccaagaagtctgtcaacatcactgagtttctgaagccagctgaaggggaaaggtactaccctggtgggcgtggtc

SEQ ID NO: 3464 - DNA, 420 bp, Glycine max
  unsure (1)..(420): unsure at all n locations
tacagctgcgagaagacgacagaaggggaaaatgaagaaaaggagcctgaggacaaggagatgacactggaagagtatgagaaggtgctggaagagaaaagaaaggccctgcaggcacaaaaaactgaagtaagaaaggtggacatcaaggagtttgcatccatgcagccactgtctaacaagaaagaaaatgatgagatctttattaaattgggatctgacaaggataaacgcaaagatgctctagagaaggaggagaagtctaagaagtctgtcaacatcactgagtttctgaagccagctgaacgggaaaggtactactctggtgggcgcggtcggngacgtggccgtggttctagaggaggtacagtggaaatgcatacagcaatgttccagctccatcaattgaggatcccgggc

SEQ ID NO: 3465 - DNA, 252 bp, Glycine max
  unsure (1)..(252): unsure at all n locations
gctcactcaggaggagaacgtgaaattcaaaggaccatgctagagttgctgaaccagttagatggttttgattcaagaggagatgtgaaagtnattctggcaaccaacagaattgaaagtcttgatccagctttgctacgacctggtcgaattgacaggaagatagaatttcctcttcctgatatcaaaacaaggagacgcatcttccagatacacacgtcaaggatgacattagctgatgatgtcaacttg

SEQ ID NO: 3466 - DNA, 265 bp, Glycine max
taaaaaggtatgatgctcactcaggaggagaacgtgaaattcaaaggaccatgctagagttgctgaaccagttagatggttttgattcaagaggagatgtgaaagtgattctggcaaccaactgaatatgaaagtcttgatccagctttgctacgacctggtcgaattgacaggaagatagaatttcctcttcctgatatcaaaacaaggagacgcatcttccagatacacacgtcaggatgacattagctgatgatgtcaattg

SEQ ID NO: 3467 - DNA, 240 bp, Glycine max
aagagatgggaagagctccttgttgtgacaaggccaatgtaaagaaagggccatggagtcctgaagaagatgaaaagctaagagagtacatagagaaacatggaactggagggaactggattgctctcccacaaaaagctggtttgaaaagatgtgggaagagttgtagactcagatggcttaattatctcagaccaaaccttaagcatggggagttttctgaaggtgaagatagaataa

SEQ ID NO: 3468 - DNA, 281 bp, Glycine max
gtgtgtgtgtgagaagagatgggaagagctccttgttgtgacaaggccaatgtaaagaaagggccatggagtcctgaagaagatgaaaagctaagagagtacatagagaaacatggaactggagggaactggattgctctcccacaaaaagctggtttgaaaagatgtgggaagagttgtagactcagatggcttaattatctcagaccaaaccttaagcatggggagttttctgaaggtgaagatagaataatctgcactctctttgctagcattggaag

SEQ ID NO: 3469 - DNA, 259 bp, Glycine max
atccaactctctttctccctatcccaacaatctcactcatacctcttcaatctaacaaacttaatttcttttgttttgagtttcttagagaatggatgaaaaaggagcaagaagtagcaacacccttttaagttgtgaggacgagatggaccttcgaagaggcccttggaccgtcgatgaagacctcactcttatcaattacattgccactcatggcgaaggtcgctggaacacgctcgccctctctgctgggctgaaa

SEQ ID NO: 3470 - DNA, 205 bp, Glycine max
ctcactcatacctcttcaatctaacaaacttaatttcttttgttttgagtttcttagagaatggatgcaaaaggagcaagaagtagcaacacccttttaagttgtgaggacgagatggaccttcgaagaggcccttggaccgtcgatgaagacctcactcttatcaattacattgccactcatggcgaaggtcgctggaacacgc

SEQ ID NO: 3471 - DNA, 273 bp, Glycine max
gaaaaactgttcccgacaaatgggaatttgccaatgagtatttcaagcgaggacagacggatcttctcgccgagatcaggcggcggaaggtggtgtctccggtgaccggaaaatctaccggcggtggcgttaacatctcggcgtcccactccggcggcgacgacatggggtcgacatcgacgggatcgatggaggcggcaacggcggcgggcgctgatatatcgggcgagaacgagaaattgaagaaggacaacgagaaattgagcggcgagt

SEQ ID NO: 3472 - DNA, 251 bp, Glycine max
ggcggaaggtggtgtctccggtgaccggaaaatctaccggcggtggcgttaacatctcggcgtcccactccggcggcgacgacatggggtcgacatcgacgggatcgatggacgcggcaacggcggcgggcgctgatatatcgggcgagaacgagaaattgaagaaggacaacgagaaattgagcggcgagttagcgctggcgaagaaacaatgcgaggagttggtggcgtttcttagagactcgctgaac

SEQ ID NO: 3473 - DNA, 251 bp, Glycine max
  unsure (1)..(251): unsure at all n locations
gcctaagcttcctccttcgcagaaccgatttggtcaacactcgcctagcagttcaatagatggtaagacatctgaaacaagcatggngtttggnaatngtgaattcngctcagaggagctaaaganaataaaggagaacgataaacttgctgaaattgccatggctgatcctaagcgtgcaaaaggattttggctaatcgtctatcagctgctcgctcaaaagagaggaagatgcggtacattctgaatag

SEQ ID NO: 3474 - DNA, 280 bp, Glycine max
cctagcagttcaatagatggtaagacatctgaaacaagcatggagtttggaaatggtgaattcagctcagaggagctaaagaaaataaaggagaacgataaacttgctgaaattgccatggccgatcctaagcgtgctaaaaggattttggctaatcgtctatcagctgctcgctcaaaagagaggaagatgcggtacatttctgaattagagctcaaagtacaaacacttcagacagagacaaccacattgtctactcagtttaccaaattacagatgg

SEQ ID NO: 3475 - DNA, 275 bp, Glycine max
aatacggctcgagggaagatgcggtacatttctgaattagagctcaaagttcaaacacttcagactgagacaaccacattgtctactcagtttaccaaattacagatgaataattcagagcttaaaagtgagaataatgagtacaaattaaggattcaagccttggaacagcagtcccaactgaaagatgctctgaatgagaccttggatgctgaagtgcggcgtttaagatgcacggtcgcagaacttggtggagagtctcttctctcaagtcg

SEQ ID NO: 3476 - DNA, 414 bp, Glycine max
tacggctgcgagaagacgacagaaggggaacgataaacttgctgaaattgccatggccgatcctaagcgtgctaaaaggattttggctaatcgtctatcagctgctcgctcaaaagagaggaagatgcggtacatttctgaattagagctcaaagtacaaacacttcagacagagacaaccacattgtctactcagtttaccaaattacagatggataattcagagctgaaaagtgagaataatgagtacaaattgaggattcaagccttggaacagcagtcccaactaaaagacgctctgaatgagaccttggatgctgaagtgcggcgtttaagacgcacagttgcagaacttggtggagagtctcttctctcaagtcgcatggctcaacagcttgctattagccaacaagt

SEQ ID NO: 3477 - DNA, 439 bp, Glycine max
gagatgaattgcctaagcttcctccttcgcagaaccgatttggtcaacactcgcctagcagttcaatagatggtaagacatctgaaacaagcatggagtttggaaatggtgaattcagctcagaggagctaaagaaaataaaggagaacgataaacttgctgaaattgccatggctgatcctaagcgtgcaaaaaggattttggctaatcgtctatcagctgctcgctcaaaagagaggaagatgcggtacatttctgaattagagctcaaagttcaaacacttcagactgagacaaccacattgtctactcagtttaccaaattacagatgaataattcagagcttaaaagtgagaataatgagtacaaattaaggattcaagccttggaacagcagtcccaactgaaagatgctctgaatgagaacttggatgctga

SEQ ID NO: 3478 - DNA, 278 bp, Glycine max
  unsure (1)..(278): unsure at all n locations
aaccctctccaaagaaaaccgtcgacaccttcggccaacgcacctccatctaccgcggcgtcacccgacatagatggacgggaagatacgaagctcatctatgggacaatagttgtagaagagaaggccaaagcaggaaaggaagacaagtttacctggtggttatgacaaggaagannaggcagccagggcgtncgannangcagcncncaagnnccngggnncaacgtccaccaccaacgttnccattncaactangagaaggaacttgaggagat

SEQ ID NO: 3479 - DNA, 395 bp, Glycine max
tacggctgcgagaagacgacagaaggggaatgccaaagttggtcacgctctctgaaaatgcagcaacagcaacagcagcagcaggcatgaagagcaacatacacaacaccactccttcaaatatcatcatcatttctcacttctcatccttcactctcttcttctctttcttcccttcactctctctttcgcttcatggctggtctcatcgatctcaacaacgccaccgaggacgatgaaacgccgtcgtctggctcctcctcctcctcctcctcctccaccgtctgccttgaactctggcacgcttgcgcgggtccaatgatttcattgcccaagaaagggagcgttgtcgtgtacttccctcagggacacttggagcaacacctccacgattt

SEQ ID NO: 3480 - DNA, 243 bp, Glycine max
tgctgatctgtcgcaagccaagcactatcaccgccgccacaaggtgtgcgagtttcactccaaagccgccaccgtcatcgccgccggcttgactcagcgattctgccagcaatgcagcaggttccatcttctttctgagtttgataacggaaaacgtagctgcaggaagagattggcagatcataatcgccgcagaagaaaaactcaacaaccaactcaagaaattcagaaatctcagccttc

SEQ ID NO: 3481 - DNA, 241 bp, Glycine max
ccaagatcagcacctgcaccagcacccaccccgccagcaacaccaccaccagcaacaccaccaccagcagcagcaactcctccaccagcaacatcaccaccagcaacaacaccaacgccaacaccaacagctgcacctacacctgcttcttctcctgcaacctcaccagtcccttccgctagttctccaccagcaccaggcacagccggacccgctcccggacccgcaggtggcgccgagc

SEQ ID NO: 3482 - DNA, 266 bp, Glycine max
  unsure (1)..(266): unsure at all n locations
gattctctcaccgatctcgcgccaaatacaaattcgtgtcaacccaacccagggttctggcgagcatggccgacggtccggctagcccaggcggcggcagccacgagagcggcgaccacagccctcgctctaacgtgcgcgagcaggacaggtacctccctatcgctaacataagcngcatcatgaagaaggcattctgccaacggtaaatcgcaaaggacgccaaagagacgttcaggatgcgtctcgagttcatcagttcatca

SEQ ID NO: 3483 - DNA, 259 bp, Glycine max
attctctcaccgatctcgcgccaaatacaaattcgtgtcaacccaacccagggttccggcgagcatggccgacggtccggctagcccaggcggcggcaccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttca

SEQ ID NO: 3484 - DNA, 248 bp, Glycine max
tctcaatcgtctccaccttgctttcttctccagcgtccgattctctcaccgatctcgcgccaaatacaaattcgttacaaccctacccagggttccggcgagcatggccgacggtccggcgagtccagcggcggtagccacgagagcggcgagcacagccctcgctctaacgtgcgcgagcaggacaggtacctccccatcgctaacataagccgcatcatgaagaaggcactacctgcgaacggtaa

SEQ ID NO: 3485 - DNA, 249 bp, Glycine max
  unsure (1)..(249): unsure at all n locations
gtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagcngcatcatgaagaaggcacttcctgcnaacggtaaantcncnt

SEQ ID NO: 3486 - DNA, 256 bp, Glycine max
  unsure (1)..(256): unsure at all n locations
ctccaccttgctttcttctccagcgtccgattctctcaccgatctcgcgccaaatacaaattcgtgtcaacccaacccagggttccggcgagcatggccgacggtccggctagcccaggcggcggcagcacgagagcggcgaccacagccctcgctctaacgtgcgcgagcaggacaggtacctccctatcgctaacataagccgcatcatgaagaaggcacttcctgccaacggtanaatcgcaaaggacgccaa

SEQ ID NO: 3487 - DNA, 268 bp, Glycine max
  unsure (1)..(268): unsure at all n locations
accgatctcgcgccaaatacaaattcgttacaaccctacccagggttccggcgagcatggccgacggtccggcgagtccaggcggcggtaccacgagagcggcgagcacagccctcgctctaacgtgcgcgaccangacaggtacctccccatcgctaacataagccgcatcatgaagaaggcactacctgcgaacggtaaaatcgccaaggacgccaaagagaccgttcaggaatgcgtatccgagttcatcagtttcatcaccagc

SEQ ID NO: 3488 - DNA, 261 bp, Glycine max
accgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttca

SEQ ID NO: 3489 - DNA, 258 bp, Glycine max
gaagaaaggaagaaaggtggagtgagtgaattcaaaaagatcacccaccatggggaggcctccttgctgtgacaaagttggcatcaagaaaggtccatggacacctgaggagatatcatccttgtctcttacatccaagaacatggtccaggaaattggagatcagtgcctactaatactgggttatcaaggtgcagcaaaagttgcaggcttagatggacaaattacctcaggccaggaatcaagagagggaacttc

SEQ ID NO: 3490 - DNA, 445 bp, Glycine max
cgggtcgaccacggaacggatgcgagaagacgacagaagggccgacaacgctatcaaaaaccactggaactccaccttgaagcgcaagtgctcttcaaccatgatcgacgacaacacccaaccgctgaaaagatccgtgagtgccggcgcggctattccagtctctactggactctacatgaacccgcccacaccgggtagtccctccggatccgatgtgagcgagtccagcttaccggttgcatcctcttcgcacgtgttccgtcccgtgcctagaactgtcaaggttctaccacccgtagaaaccacgtcgtcctccaatgaccctccaacttcactttctctaacactccccggtgttggtgttgttgactcaaccgaagtctccaatcggacaactgagccgattcactttacaccgccaatgccacatcggtcgaatact

SEQ ID NO: 3491 - DNA, 353 bp, Glycine max
cgctatcaaaaaccactggaactccaccttgaagcgcaagtgctcttcaaccatgatcgacgacaacacccaaccgctgaaaagatccgtgagtgccggcgcggctattccagtctctactggactctacatgaacccgcccacaccgggtagtccctccggatccgatgtgagcgagtccagcttaccggttgcatcctcttcgcacgtgttccgtcccgtgcctagaactgtcaaggttctaccacccgtagaaaccacgtcgtcctccaatgaccctccaacttcactttctctatcactccccggtgttggtgttgttgactcatccgaagtctccaatcgggcaactg

SEQ ID NO: 3492 - DNA, 391 bp, Glycine max
acgtacggctgcgagaagacgacagaaggggaaaaccagggaagattctatttcatttccttgccaacttagagagagagagagagagagatggcaattgggttcatggaggtgcagcttgtgaaagcaaagggtcttcaggaaacagatatctttgctcatatggacccgtatgtacggttacaatacaaaggtcaagagcgcaagagcagtgtaattcatgagggcggcagaaatcccatatggaatgagaaatttgtattcagagtggaataccctggatcaggtgatcaatacaagctcaaccttagaatcatggacaaggatgtattttctgcagatgactttgtcggccaggctacaatctatgtgaaggatttattggcggaag

SEQ ID NO: 3493 - DNA, 264 bp, Glycine max
gtggccgtggttcacgaggcggaggcggttaccatggaagtgccaccaacaatgcacctgctccatccattgaagatcccgggcatttcccaaccttgagtgccaagtgaggccttcccagaacccttttgacatatctctgtcctattttcaattttgggttctcttatttgaacttaagcaggaaaggaactatggtaattggatttcctggattagaaggttcatttaattttatgccttaaaagtgtaaatttaggttgt

SEQ ID NO: 3494 - DNA, 350 bp, Glycine max
cccaagcgtccatacggctgcgagaagacgacagaagggggttcacgaggtggaggcggaggcggaggtgtttaccgtggaagttccaccaacaatgcacctgctccatccattgaagatcctgggcatttcccaaacttgggtgccaagtgaggccttgctagaacccttttgtcacatccctgtcctaatttcaattttgggttcgcttaggtgaacttaatcaggaaaataactatggtacttggatttcctggattggaacgttcacttaattttatgccttgaaagtgtaaatttatgttgttgttcttcatacagtcctgtacccttgaagcctgatccccctt

SEQ ID NO: 3495 - DNA, 250 bp, Glycine max
ctcgagccgacaatgacataaagaactattggaacacccatttgagaaagaagctgaagaagacccaagtaggttgtgaaggtggtagctttggagaagggttttcagcctcaaggcaaatccctagaggccagtgggaaagaaggctccaaactgatatccaaatgcgcaaagagagccctcagtgaagctctttcaccagagaccccatcttgtaatttatctgcctcaaactcaacccttcagatag

SEQ ID NO: 3496 - DNA, 384 bp, Glycine max
gggaagttctatcttttggatccacatgcttaacttaactggatcacattggctatgttaaagatgggctgcaatagctttataccttccacagagaacagacaatgacataaagaactattggaacacccatttgagaaagaagctgaagaagatgcaagtaggttgtgaaagtggtagctttggagaaaggttttcagcctcaaggcaaatccctagaggccagtgggaaagaaggctccaaactgatatcccaatggcaaacagagccctcagtgaagctctttcaccagagaagccatcttgtaatttatctggcataaactcaaacccttcagatatgttcagcttcatctttttcacaaaaccaacttctacacaaac

SEQ ID NO: 3497 - DNA, 263 bp, Glycine max
cacaaacaagtggatcaaagagaccatcagagccgtcgatggagttggctaacccccgaaacgaaactgcttctgcccctcaaccacccaaacctgtcaagcgagagggcaatcgcaaaggtccaacgtcaagttctgaacatgaaggacctaaaacaccagatcctaagacactcagaagacttgctcagaatagagaggcagctaggaaaagcaggcttaggaaaaaggcctatgttcaacaactagagtcgagtaggatt

SEQ ID NO: 3498 - DNA, 370 bp, Glycine max
caaaactcatcatcaggaatgaggcctccaactctcaacattttcccctctaagcctgggcatgtagagccatcatcatccaaggccaaggctaacatagagctagtttctccacaaacaagtggatcaaagaggccatcagagccgtcgatggagttggccaaccctcgaaacgaaactgcttctgcccctcagccacccaaacctgtcaagcgagagagcaaccgcaaaggtccaacgtcaagttctgaacatgaaggacctaaaacaccagatcctaagacactcagaagacttgctcaaaataaagaggcagctaggaaaagcaagcttaggaaaaaggcatatgttcaacaactagagtcgagta

SEQ ID NO: 3499 - DNA, 240 bp, Glycine max
ctcgagccgcagaaatgcaactatggagcgcctgaggacaatgtggcaacaaaggaagccttggtattggagttaagcagtcaacaagaatacttgaggctgaaagcacgttatgaagctctacaacgttctcaaaggaaccttatgggagaagatcttggccctctaagcagcaagagcttgaatcacttgaacggcagctagattcgtctttgaagcaaatcagatcaataaggaccc

SEQ ID NO: 3500 - DNA, 410 bp, Glycine max
gcctgaggacaatgtggcaacaaaggaagccttggtattggagttaagcagtcaacaagaatacttgaggctgaaagcacgttatgaagctctacaacgttctcaaaggaaccttatgggagaagatcttggccctctaagcagcaaagagcttgaatcacttgaaaggcagctagattcgtctttgaagcaaatcagatcaataaggacccaattcatgctggatcagctttctgatctacaacgtaaggaacactttctaggtgagtcaaacagagatctcagacaaaggttggaagagtttcaaataaatccactccaactgaatcccagtgctgaagatatggggtatggacgccatccaggtcagccccaaggccatgctctctttcaaccattggagtgtgagc

SEQ ID NO: 3501 - DNA, 308 bp, Glycine max
agcccacgcgtccgtacggctgcgagaagacgacagaagggggtattggagttaagcagtcaacaagaatacttgaggctgaaagcacgttatgaagctctacaacgttctcaaaggaaccttatgggagaagatcttggccctctaagcagcagagagcttgaatcacttgaaaggcagctagattcgtctttgaagcaaatcagatcaatagggacccaagtcatgctggatcagctttctgatctacaacgtaaggaacactttctaggtgagtcaaacagagatctcagagcaaggttggaaga

SEQ ID NO: 3502 - DNA, 338 bp, Glycine max
  unsure (1)..(338): unsure at all n locations
aatgaacctatgatgggatcaaacagattgacaccaatggctcctcatggatgctttcccgcatatttacctgttccttnttcccgtgtgggcatcaacttgggttcacccctttgaagaagttaagggaggagagacatgccaccatcagatccacaagccaatcccagtcattccaaaggaacctgttaatgttgacgaacttgtgggaatgtctcatctaagcattggggaagcacaggtacgtgatagagagccttcccctctttccataaagttgttaggagagccctcaaggcagtcagcattcnatgcaaatgtcccggttggtagttcgg

SEQ ID NO: 3503 - DNA, 374 bp, Glycine max
aagaatttgaacccatggagactacttctcaagaaaatgcgcaacagaccaatgaaactatgatgggatcaatcggactgacaccaatggctcctcatggattctttcctgcatatttacctgttccatttcccatgtggccatcaactgtggctcccccgtttgaagaagttaagggaggagagacatcccaccatcagatccacaagccaatcccagtcattcccaaggaacctgttaatgttgacgaacttgtgggaatgtctcatctaagcattggggaagcaaaggtacgtgatagagagccttcccctctttccttaaagttgttaggagagccctcaaggcagtcagcattccatgcaaatgctcca

SEQ ID NO: 3504 - DNA, 268 bp, Glycine max
ctgtgtttacccctctagtcctagcaatgctggaacaggcaccacagcaactccaacaaccactacaccaacaacaggcacaccacccaccaccttaactccaaccacccccactactaccactccaggcacaaccaccggtaccagcccaaccactggcactggtaccggcaccggcaccggcaccaccataggtaaccctaatgtgtttggaatgagtccaacatcttcaactggaacaggaggaggcttcaatgacccaaacaaa

SEQ ID NO: 3505 - DNA, 444 bp, Glycine max
gctatttccagagaaagggtcaagctcagggaagctgtgatttttctggtgctgccacccctagtcaaacaccacccactgcagcatctacatgtgtttacccctctagtcctagcaatgctggaacaggcaccacagcaactccaacaaccactacaccaacaacaggcacaccacccaccaccttaactccaaccacccccactactaccactccaggcacaaccaccggtaccagcccaaccactggcactggtaccggcaccggcaccggcaccaccataggttaccctaatgtgtttggaatgagtccaacatcttcaactggaacaggatgaggcttcaatgacccaaacaaaggagtggttcatttgcaagacattatcatgttgctagagtcccctggtatcacacttttgctaggaatgtttagggtctaataat

SEQ ID NO: 3506 - DNA, 281 bp, Glycine max
  unsure (1)..(281): unsure at all n locations
cgatcaccatgttgcgacaaggtaggtttaaagaaaggaccatggactcctgaggaagatcagaagctcttagcttatattgaagaacatggccatggaagctggcgtgccttgccancaaaagctggacttcagaggtgtggcaagagttgcagactaagatggaccaattatctcaggcctgacattaagaggggaaagttcagtttgcaagaagaacaaaccatcattcaactccatgccctcttaggaaacaggtggtcggcaatagccacacactt

SEQ ID NO: 3507 - DNA, 253 bp, Glycine max
gtttccacttgcaaatgggaccatcaccatgctgcgacaaggtaggtttaaagaaaggaccatggactccagaggaagatcagaagctcttagcttatattgaagaacatggccatggaagctggcgtgctttgccagcaaaagctggacttcagaggtgtggcaagagttgcagactaagatggaccaattatcttaggcctgacattaagaggggaaaattcagcttgcaagaagaacaaaccatcattca

SEQ ID NO: 3508 - DNA, 256 bp, Glycine max
ccaccatgctgtgacaaggtgggtttaaagaagggaccgtggacgccagacgaagatcagaagctcttggcttatattgaagaacatggccatggaagctggcgtgctttgccagcaaaagctggacttcagaggtgtggcaaaagttgcaggttgagatggactaattatctaaggcctgatattaagaggggaaagttcagcatgcaagacgagcaaaccatcattcaactccatgcactattagggaacaggt

SEQ ID NO: 3509 - DNA, 300 bp, Glycine max
gacgatcaccatgctgcgacaaggtaggtttaaagaaaggaccatggactccagaggaagatcagaagctcttagcttatattgaagaacatggccatggaagctggcgtgctttgccagcaaaagctggacttcagaggtgtggcaagagttgcagactaagatggaccaattatcttaggcctgacattaagaggggaaaattcagcttgcaagaggaacaaaccatcattcaacttcatgccctcttaggaaacaggtggtcggcaatagccacacacttgccagagagaacggaca

SEQ ID NO: 3510 - DNA, 275 bp, Glycine max
ctccattgatctgcgcctcctgttccatggcaaagctgcctgtggaatacaacggcgactgcgccaccaccgcctcagcatccgcctccgcagccgcggagtctcagagatccattcccacgccgtttctcaccaaaacctttcaactcgtcgacgaccaatccatcgacgatgttatttcctggaacgacgacggatcaacgtttatcgtctggaaccctaccgtcttcgccagagacttgcttcctaaatatttcaaacacaacaattctcta

SEQ ID NO: 3511 - DNA, 248 bp, Glycine max
attctgcccttccctcgcgtttcaacaccgataacccgcaaaaatctccattgatctgcgcctcctgttccatggcaaagctgcctgtggaatacaacggcgactgcgccaccaccgcctcagcaccgcctccgcagccgcggagtctcagagatccattcccacgccgtttctcaccaaaacctttcaactcgtcgacgaccaatccatcgacgatgttatttcctggaacgacgacggatcaacgt

SEQ ID NO: 3512 - DNA, 247 bp, Glycine max
attctgcccttccctcgcgtttcaacaccgataacccgcaaaaatctccattgatctgcgcctcctgttccatggcaaagctgcctgtggaatacaacggcgactgcgccaccaccgcctcagcaccgcctccgcagccgcggagtctcagagatccattcccacgccgtttctcaccaaaagctttcaactcgtcgacgaccaatccatcgacgatgttatttcctggaacgacgacggatcaacg

SEQ ID NO: 3513 - DNA, 257 bp, Glycine max
caccgccgccggtggaacacaacggcgactccgccgctaccgcctctgcctccgcctccgcctccgcggagtctcagagatcaattcccacgccctttctcaccaaaacctatcaactcgtcgacgaccaatccatcgacgacgttatttcctggaacgacgacgggtcaacgtttatcgtctggaaccctaccgttttcgccagagacttcttcctaaatttttcaaacacaataatttctctagcttcgttcgcc

SEQ ID NO: 3514 - DNA, 273 bp, Glycine max
tacccattgatctgcgcctcctcttccatggctccaccgccgccggtggaacacaacggcgactccgccgctaccgcctccgcctccgcctccgcggagtctcagagatcaattcccacgccctttctcaccaaaacctatcaactcgtcgacgaccaatccatcgacgacgttatttcctggaacgacgacgggtcaacgtttatcgtctggaaccctaccgttttcgccagagacttgcttcctaaatttttcaaacacaataatttctct

SEQ ID NO: 3515 - DNA, 354 bp, Glycine max
gaagtagaggtcttaagagtttgagaactgagaagagatgggtggtgttgcatggacagaagaagaagatcacttgctcaagaaatgcatacaacaatatggagaaggaaagtggcatcgtgttcctttactggctggtttaaacaggtgccggaagagttgtaggctaagatggctgaactatctccgtcctaacatcaagagaggaaattttgcggaggaagaagtggaaatgataatcaaactccataaattactaggcaacagatggtcgttgattgcaggaaggctaccaggaaggactgccaatgatgtgaaaaactattggaactgtcatctgagcaaaaaacttaa

SEQ ID NO: 3516 - DNA, 368 bp, Glycine max
gaagtagaggtcttaagagtttgagaactgagaagagatgggtggtgttgcatggacagaagaagaagatcacttgctcaagaaatgcatacaacaatatggagaaggaaagtggcatcgtgttcctttactggctggtttaaacaggtgccggaagagttgtaggctaagatggctgaactatctccgtcctaacatcaagagaggaaattttgcggaggaagaagtggaaatgataatcaaactccataaattactaggcaacagatggtcgttgattgcaagaaggctaccaagaaagactgccaatggttgtgaaaactattggaactggcatctgagcaaaaaactaaatgtaatagaagctg

SEQ ID NO: 3517 - DNA, 266 bp, Glycine max
gtagaggaagaaatcaagatgctttattggctgcttgtctctacatcgcttgccgacaagaagacaaacctcgtactgtaaaggaaatttgctctgttgccaatggggccacaaagaaggaaattggccgagctaaagaatacatagtaaaacaactgggtttggagaacggtaatgctgtggagatgggtacaatacatgcaggggacttcatgaggcgattctgttctaatctttgtatgaataatcaagctgttaaagctgct

SEQ ID NO: 3518 - DNA, 404 bp, Glycine max
  unsure (1)..(404): unsure at all n locations
cctcgtactgtaaaggaaatttgctctgttgccaatggggccacaaagaaggaaattggccgagctaaagaatacatagtaaaacaactgggtttggagaacggtaatgctgtggagatgggtacaatacatgcatgggacttcatgaggcgattctggtctaatcttcgtatgaataatcaagctgttaaagctgctcaggaagctgtgcataaatcagaagaatttgatataaggaggagtcccatttcaattgctgcagcagttatatacatcataactcagctttctgatgataagaaacctctcaaagatatatcacttgccacaggcgttgcagaaggaacgattaggaactcctacaaggatctttatccccatgtntccaaaataataccaaattg

SEQ ID NO: 3519 - DNA, 263 bp, Glycine max
attagatcagattgaacaaaagggtttttctttctttctttcttggggaataatagaaataagaaaagattagtgaggttgaaatgtcgcaacgatcggtgccggcgccgttcttgacgaagacgtatcagttggtggaggatcaggggacggaccaggtgatatcgtggggtgaaagtgggaacacttttgtggtgtggaagcatgcggattttgcaaaggatttgcttccaaaatatttcaagcacaacaacttctccagc

SEQ ID NO: 3520 - DNA, 423 bp, Glycine max
  unsure (1)..(423): unsure at all n locations
acgcgtccacctttatgggttctattgctgggattgggaattccttaacgctcccctcccttttaattcctccccctaaacctccttcctcaaaaattttaattccctccctaataaaacttataaattaaaattaaacaaaagggttttccttccttcctttcttggggaataataganataagaaaagattagtgaagttgaaatgtcgcaacgatcggtgccggcgccgttcttgacgaagacgtatcagttggtggaggatcaggggacggaccaagtgatatcgtggggtgaaagtgggaacacttttgtggtgtggaagcatgcggattttgcaaaggatttgcttccaaaatatttcaagcacaacaacttctccagctttgttcgacagctcaatacctatggattccgaaaaat

SEQ ID NO: 3521 - DNA, 255 bp, Glycine max
gaaacacaaacactgaaacactcaagtgagttcgatagtatatttgtgtttctttttcacaaagatggtgagaaccccgtcttgtgacaaaagtggaatgaggaaaggtacttggactccagaggaagatatgaagttaattgcttatgtcactaggtatggctgctggaattggcgccaactccccaagtttgcaggtcttgcaagatgtgggaaaagttgtagattgagatggatgaattatctaaggcctaa

SEQ ID NO: 3522 - DNA, 248 bp, Glycine max
gagaaacacaaacactgaaacactcaagtgagttcgatagtatatttgtttttctttttcacaaagatggtgagaaccccgtcttgtgacaaaagtggaatgaggaaaggtacttggactccagaggaagatatgaagttaattgcttatgtcactaggtatggctgctggaattggcgccaactccccaagtttgcaggtcttgcaagatgtgggaaaagttgtagattgagatggatgaattatct

SEQ ID NO: 3523 - DNA, 427 bp, Glycine max
ctaagtcccaaaacacacataaattgagcacattagagattaggttagtgtgacactcgcctcaccctctctctgtctctcccctgcggctagggttttgtctttcactcactctcttctctttcttttcttctcattccccttctctttcgatctgaacaataataattaaccatggaaccgtcgctgagttaacctttttcttctgcgcggtgctgttctcttttgttgtttgggttttttttttctttctgagaagggcttgttgttgttgtgtttcgaaataatggcgactacgaatccctttgatttgttgggcgacgacgccgaagacccctcacagttgatcgcggcggagcaactgaaggccgcggcagccgcggccaccgcgccacccaagaaggaccaggccaagcccggagctcgc

SEQ ID NO: 3524 - DNA, 242 bp, Glycine max
ctcgaacctggatgcgctattttgatgcataacaaggttctctctgttgttgggcttcttcaagatgaagttgatccaatggtctctgttatgaaggtcgaaaaggcccctttggaatcatatgctgatattggtggtttagatgctcagatacaggaaattaaagaagcagttgagcttcccctgacacatcctgaactgtatgaagacattggtatcaagcctcctaagggagttatttt

SEQ ID NO: 3525 - DNA, 369 bp, Glycine max
acgtacggctgcgagaagacgacagaagggcgaggaagatagatccaaggtcgatgatctcagaggttcccctatgagcgttggtaacctcgaggaactcatcgacgagaatcatgccatcgtttcgtcctcggtggggcccgagtactatgttggtattttgtctttcgttgataaggatcagctcgaacctggatgcgctattttgatgcataacaaggttctctctgttgttgggcttcttcaagatgcagttgatccaatggtctctgttatgaaggtcgaaaaggcccctttggaatcatatgctgatattggtggtttagatgctcagataccggaaagttaagaaacagttgagcctcccct

SEQ ID NO: 3526 - DNA, 254 bp, Glycine max
tgaccctccaacctcactttccctatccctccccggtgttgactcatccgaagtttccaatcgaacaactgagccgattcatgccgcacctcctccgccgccacagccacagccacagccacagccgttgaatactatccctttgctcccaatgatgacggtgccctcggtttctccgacggggatggcgccgtttaattttagcgcagagtttctggcggtgatgcaggaaatgataaggaaggaggtgagga

SEQ ID NO: 3527 - DNA, 428 bp, Glycine max
caacgactttgtcttccaatgaccctccaacctcactttccctatccctccccggtgttgactcatccgaagtttccaatcgaacaactgagccgattcatgccgcacctcctccgccgccacagccacagccacagccacagccgttgaatactatccctttgctcccaatgatgacggtgccctcggtttctccgacggggatggcgccgtttaattttagcgcagagtttctggcggtgatgcaggaaatgataaggaaggaggtgaggagttatatggagttgcacaatcagaagaatgggatgtgttttcaggctgcggtgaatgatgggtttagggacgcctcggtgaagcgtattgggaatagcaggggtgattcgtaaatattatcatcgaagaatggaacaacacaagtagagatgagg

SEQ ID NO: 3528 - DNA, 255 bp, Glycine max
  unsure (1)..(255): unsure at all n locations
atggtttcaggaaaattgatacggattcctgggaatttgccaatgaaaactttgttaggggtcaaaagcatttgttgaagaatatacatagaaggaaacatccacacagtgcagatcacaaaaggcattgccacagcaagacaattgtgatgaaccatcccaagaagcaccaaatcatggcctttgggaaagaagttgagaatctanaacttgntaaaaattcgctcacacaggattggtcaaacttnggcnacc

SEQ ID NO: 3529 - DNA, 449 bp, Glycine max
agaaaattgatacggattcctgggaatttgccaatgaacactttgttaggggtcaaaagcatttgttgaagaatatacatacaaggaaacatccacacagtgcagatcagcaaaaggcattgccacagcaagacaattgtgatgaaccatcccaagaagcaccaaatcatggcctttggaaagaagttgagaatctaaaacttgataaaaattcgctcacacaggaattggtcaaacttaggcaacatcaggaatctgctgagagtaagttgctgctcctgagtgatcgccttcaaggaatggaaaagcatcagcagcagatgttgtcattcttagtcatggttgtgcaaagccctgtgttcatggttcagcttcttcatcctaatgaaaataattggcgtctggctgaatcatggaatagattggatcaagatacacaagatgacaag

SEQ ID NO: 3530 - DNA, 243 bp, Glycine max
gtgatgagaagcctgcagttgaagaagatgtagctgatggaaacaaggacagccctactaatgaaagcgaagaaaaagagcctgaagataaggaaatgactctggaggaatatgaaaaagtgttggaagagagaaggaaggccttccaagcactcaagactgaagagagaaaggtggacactaaagagtttgaatccatgcaggccttatcaagcaagaaagataatcatgacatattcatta

SEQ ID NO: 3531 - DNA, 306 bp, Glycine max
gacccacgcgtccgtacggctgcgagaagacgacagaaggggaacttgctcaggtaactgatgaggttgcgagtgaaagtgaaaagaattggggtgatgagaagcctgcagttgaagaagatgtagctgatggtaacaaggacagccctactaatgaaactgaagaaaaagagcctgaagataaggagatgactctggaggaatatgaaaaagtgttggaagagagaaggaaggccttccaagcactcaatactgaagatagataagtggacactaaagagtcttaatacatgcaggccttattat

SEQ ID NO: 3532 - DNA, 252 bp, Glycine max
tgtggttcagaaacaaatgaggtttacacctactatagatcgcttcccatgccagtcacttcacacaaatttgggtccattgatcccatttctggtaaagacactgatgatgacaatggtcagtttgtttcaagtgtgtgctggagagggaaatcgggcatgcttattgcggccaattcaagtggatgtgtaaaagtgttacagatggtttaaagaaaaggttccatgtgacggcgactttcttacatttgc

SEQ ID NO: 3533 - DNA, 474 bp, Glycine max
tcgtccacgcgtccggatcttcgcaatctcagaagtccctggtgggtactggctgggccatcgtaagctgtgagctatgtcaaattcttggactctgaaacacttgtttctgcttctactgataatacattgaagatctgggatctcaataaaacctctcctgtgggtgcatccattaatgcttgcagcctaactctgtcaggacatactaatgagaagaattttgtgggtctatcggtggctgatggatatattgcatgcggttcagaaacaaatgagatttacacctactatagatcgcttcccatgccaatcacttcacacaaatttgggtccattgatcccatttctggtaaagacactgatgatgacaatggtcagtttgtttcaagtgtatgctggagagggaaatcagacatgcttattgcggccaattcaagtgggtgtgtaaaagtgttacagatggtttaagga

SEQ ID NO: 3534 - DNA, 230 bp, Glycine max
cgagagtgaagcttccgatcaaaaagattgagaacacaaccaataggcaagtcactttctccaagaggaggaatggactcatcaagaaagcttacgaactttctgttctttgtgatgttgatgtggctctcatcatgttttccccatcaggaagagccactttcttctctggcaacaaaagcattgaagaaattctagaacgatatgttaatctttcggagggtgaacac

SEQ ID NO: 3535 - DNA, 431 bp, Glycine max
gaaatatggggagagtgaagcttccgatcaaaaagattgagaacacaaccaataggcaagtcactttctccaagaggaggaatggactcatcaagaaagcttacgaactttctgttctttgtgatgttgatgtggctctcatcatgttttccccatcaggaagagccactttcttctctggcaacaaaagcattgaagaaattctagaacgatatgttaatctttcggagggtgaacacggaaggatgcataataaagagcacattcaaaagttgcttagtaagttgaaagatgaagctggtcaaatatgtcaagcccctagctcaatgacttcagattcccaaattgaggatcttcgaagagaaattttcacttgcaagtctcaattggaagagatggagaagcgactaaggatatttgaaggtgatcct

SEQ ID NO: 3536 - DNA, 287 bp, Glycine max
agggtttgcaactgaatgaggctctcacctcgccacgtaatcttttaagcaattaaagaaggaataggataatgattagtgaaaaaagaaaaggctaagcgataattattttgggtaaaagaccaaatgcactagcctatgctttctacacatgttgaggttgtgtaatttgtaatgtacgtaggtcaatgcctctatgaatattgactattaaaacctgtttaatttccactgcagccactgccataagtcccaaacaatgcttcaaaccctaccaacactgcagc

SEQ ID NO: 3537 - DNA, 233 bp, Glycine max
ctcgcctcaaggagtcaaagcccgttgttgactttggagctgtaaatgtcatgatgaagagcaacagggtttgcaactgaatgaggctctcacctcgccacgtaatcttttaagcaattaaagaaggaataggataatgattagtgaaaaaagaaaaggctaagcgataattatgtttgggtaaaagaccaaatgcactagcctatgctttctacacatgttgaggttgtgta

SEQ ID NO: 3538 - DNA, 290 bp, Glycine max
ctccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgagaagtgattctagcgtcaggcggccaaagaagcgagcgggaagaagagtcttcaaggagacaaggcaccccgtctaccgaggagtgcgtcgcagggaacaagaacaagtgggtctgcgagatgcgagtccccaacaacaac

SEQ ID NO: 3539 - DNA, 269 bp, Glycine max
gcaccccctcagacgaagaagtgattctagcgtcacgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgagacatacccaacgcccgatatggccgcacgtgcgcacgacgttgcggcgctcgcgctcaggggaaagtccgcgtgcctcaacttcgcggactcca

SEQ ID NO: 3540 - DNA, 270 bp, Glycine max
ctccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcaggaacaagaaca

SEQ ID NO: 3541 - DNA, 278 bp, Glycine max
aaactccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcacgcggccaaagaagcgagcgggaagaagagtcttcaaggagacaaggcaccccgtctaccgaggagtgcgtcgcaggaacaagaacaagtggg

SEQ ID NO: 3542 - DNA, 291 bp, Glycine max
cttctggaatgaacattttcaaatccccactggaccatgatttgaactgtggtggaatattccacgactcagcacgactaccctaattcgtctgaaacaaggagcaccccctcagacgaagaagccattctagcgtcaggcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgc

SEQ ID NO: 3543 - DNA, 274 bp, Glycine max
caacttcttgaatgaacattttcaaatccccactggaccatgatttgaactgtggtggaatattccacgactcagcagaactatcttattcgtctgaaacaaggagcaccccctcagatgaagaagtgattctagcgtcagcgcggccaaagaagcgagcgggaagaagagtcttcaaggagacaatgcaccccgtctaccgaggagtgcgtcgcaggaacaagaacaagtgggtctgcgagatgcgagtccccaacaacaactcacggatttg

SEQ ID NO: 3544 - DNA, 350 bp, Glycine max
caaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcacgaacaagaacaagtgggtctgcgagatgcgagtccccaacaacaactcacggatttggctcgggacatacccaacgcgcgaaatggccgcacgt

SEQ ID NO: 3545 - DNA, 255 bp, Glycine max
atgcacttttctttcttttctcttcttcttctatccataatttcaattccatttgctctctggaccgagtcaggcggcggcgaatcggcatgactcggcgctgctcccactgcaccaacaacggccacaactcccggacatgcccgtcgcggggagggggcggcgtcaagctgttcggggtgaggctgacggatggatcaatcataaagaagagcgctagcatggggaaccttaacctctcctcctcctcctcct

SEQ ID NO: 3546 - DNA, 407 bp, Glycine max
caattccatttgctctctggaccgagtcaggcggcggcgaatcggcatgactcggcgctgctgccagggcaccaacaacggccacaactcccggacatgcccgtcgcggggagggggcggcgtcaagctgttcggggtgaggctgacggatggatcaatcataaagaagagcgctagcatggggaaccttaacctctcctccttctcctcctccgccgccgccgcacatctgcaattccgttcatctccttcttcttccaacctccccgcggcctcatcgcccaatccaagctccccgtgctccgacccgccccaaggctacttgtccgatgaccccgcccacgtctccaccttcgctaaccgccgcggtgatagaaaaaaaggtgtgccatggactgaagaaaaca

SEQ ID NO: 3547 - DNA, 271 bp, Glycine max
cttagcaatgtgaaggattaccaccgtcgccacaaagtttgtgatatgcattctaaggctacccaggcactagttggaaatgttatgcagagattctgtcaacagtgtagcaggtttcatgttcttcaagaatttgatgaagggaagagaagctgtcgtaggcgtctggctggccacaataaaaggaggaggaaaacgcatcctgatgcaactgtagttaatggaggctctctgaatgaagaaaagggcagtagctatttgttaatgagtc

SEQ ID NO: 3548 - DNA, 348 bp, Glycine max
  unsure (1)..(348): unsure at all n locations
cccactcgttcgcccactcgtccggggaggagaaaagtggaaagaagacaaagatgacggcgagtgcttcgagccgggctgtttgtcangtggaagattgtagggctgatcttagtaatgcgaaggattaccatcgccgtcacaaagtttgtgatatgcattctaaggctacccaggcactagttggaaatgttatgcagagattctgtcaacagtgtagcaggtttcatgttcttcaagaatttgatgaatggaagagaagctgtcgtaggcgtctggcatgccacaataaaaggaggaggaaaacacttcctgatgcaactgtagttaatggatgctctctgaatg

SEQ ID NO: 3549 - DNA, 289 bp, Glycine max
  unsure (1)..(289): unsure at all n locations
ctttctcttccaccgccatcatctcttataacctccacngccctacacacccttntaatatgcctcantccccccaccacctcccactctnttnttttcacacccctcctcattcttcttcttcacactaattcagaatcaacatgaacccaatgatgctaactctcctaagccgttggagattctgcagatgaaccctgttcctccgtttttgtccaagaccttcgacctcgtcgacgacccgactctcgaccccattatctcatggggctccaccggttttagcttc

SEQ ID NO: 3550 - DNA, 319 bp, Glycine max
  unsure (1)..(319): unsure at all n locations
atcttcttattctctttcatctctgatggagacgttgcgggtttagttctaaggggtggttctggccttgggtttttggaacgtacggtgtcgttttggggttgggaaaacaaattctgagagatggcaaccacgaacccttttgatttgttgggtgacgacgctgaggacccttctcagctcatcgccgccgagcaactcaaggcggcggctgcggcctcggcggccaccgcggctcccaagaaggcgccggctcagcagaacaagccggntcagctcctaccaagccgcctcctccggntcaggctntgaggatgcc

SEQ ID NO: 3551 - DNA, 270 bp, Glycine max
ctcacacactcactctccttctctctcctattgcggctagggtttgggtttttcactttcagcctctccattccttcaaccttcttcttttctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcgccg

SEQ ID NO: 3552 - DNA, 263 bp, Glycine max
cttctctctcctattgcggctagggtttgggtttttcactttcagcctctccattccttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcgccgccgagcaact

SEQ ID NO: 3553 - DNA, 283 bp, Glycine max
ctagggtttgggtttttcactttcagcctctccattccttcaaccttcttcttctctttgatctctgatggagacgttccgtgtttagtagcaagggttagttgaggccttgtgtttggaaacgtacggtgtcgttttggagttgggaacacaaataattctgagagatggcaaccacgaacccttttgatttgttgggtgacgacgctgaggacccttctcagctcatcgccgccgagcaactcaaggcggcggctgctgctgcggctgccaccgccgctcc

SEQ ID NO: 3554 - DNA, 250 bp, Glycine max
agggtttgggtttttcactttcagcctctccattccttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcgccgccgagcaactcaaggcgg

SEQ ID NO: 3555 - DNA, 260 bp, Glycine max
actcactctccttctctctcctattgcggctagggtttgggtttttcactttcagcctctccattccttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcg

SEQ ID NO: 3556 - DNA, 250 bp, Glycine max
ctctcctattgcggctagggtttgggtttttcactttcagcctctccattccttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcgccgcc

SEQ ID NO: 3557 - DNA, 275 bp, Glycine max
  unsure (1)..(275): unsure at all n locations
ctcacacactcactctccttctctctcctattgcggctagggtttnggttcttcactttcagcctctccattccttcaaccttcttacttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgangacccttctcagctcatcgncgccga

SEQ ID NO: 3558 - DNA, 276 bp, Glycine max
ctctcacacactcactctccttctctctcctattgcggctagggcttgggtttttcactttcagcctctccattccttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcgccgccga

SEQ ID NO: 3559 - DNA, 282 bp, Glycine max
ctctcacacactcactctccttctctctcctattgcggctagggtttgggtttttcactttcagcctctccattccttcaaccttcttcttctctttgatctctgatggagacgttccgtgtttagtagcaagggttagttgaggcctgtgtttggaaacgtacggtgtcgttttggagttgggaaaacaaataattctgagagatggcaaccacgaacccttttgatttgttgggtgacgacgctgaggacccttctcagctcatcgccgccgagcaactc

SEQ ID NO: 3560 - DNA, 284 bp, Glycine max
attatattctctcactctcttactctttcactctacttctctctgatattgcggctagggtttaggtttttctttcaccgtctccgttccttcaatcttcttattctctttcatctctgatggagacgttgcgggtttagttctaaggggtggttctggccttgggtttttggaacgtacggtgtcgttttggggttgggaaaacaaattctgagagatggcaaccacgaacccttttgatttgttgggtgacgacgctgaggacccttctcagctcatcgccg

SEQ ID NO: 3561 - DNA, 284 bp, Glycine max
attatattctctcactctcttactctttcactctacttctctctcctattgcggctagggtttaggtttttctttcaccgtctccgttccttcaatcttcttattctctttcatctctgatggagacgttgcgggtttagttctaaggggtggttctggccttgggtttttggaacgtacggtgtcgttttggggttgggaaaacaaattctgagagatggcaaccacgaacccttttgatttgttgggtgacgacgctgaggacccttctcagctcatcgccg

SEQ ID NO: 3562 - DNA, 238 bp, Glycine max
ctggccttgggtttttggaacgtacggtgtcgttttggggttgggaaaacaaattctgagagatggcaaccacgaacccttttgatttgttgggtgacgacgctgaggacccttctcagctcatcgccgccgagcaactcaaggcggcggctgcggcctcggcggccaccgcggctcccaagaaggcgccggctcagcagaacaagccggctcagctccctaccaagccgcctcctcc

SEQ ID NO: 3563 - DNA, 276 bp, Glycine max
attctctcactctcttactctttcactctacttctctctcctattgcggctagggtttaggtttttctttcaccgtctccgttccttcaatcttcttattctctttcatctctgatggagacgttgcgggtttagttctaaggggtggttctggccttgggtttttggaacgtacggtgtcgttttggggttgggaaaacaaattctgagagatggcaaccacgaacccttttgatttgttgggtgacgacgctgaggacccttctcagctcatcg

SEQ ID NO: 3564 - DNA, 270 bp, Glycine max
ctctcacacactcactctctttctctctcctattgcggctagggtttgggtttttcactttcagcctcctcaattctttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcg

SEQ ID NO: 3565 - DNA, 270 bp, Glycine max
gttctctcacacactcactctccttctctctcctattgcggctagggtttgggtttttcactttcagcctctccattccttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcat

SEQ ID NO: 3566 - DNA, 396 bp, Glycine max
atattctctcactctcttactctttcactctacttctctctcctattgcggctagggtttaggtttttctttcaccgtctccgttccttcaatcttcttattctctttcatctctgatggagacgttgcgggtttagttctaaggggtggttctggccttgggtttttggaacgtacggtgtcgttttggggttgggaaaacaaattctgagagatggcaaccacgaacccttttgatttgttgggtgacgacgctgaggacccttctcagctcatcgccgccgagcaactcaaggcggcggctgcggcctcggcggccaccgcggctcccaagaaggcgccggctcagcagaacaagccgggttcagttccttaccaagccgcttcttccggtta

SEQ ID NO: 3567 - DNA, 368 bp, Glycine max
ctgttctctcacacactcactctccttctctctcctattgcggctagggtttgggtttttcactttcagcctctccattccttcaaccttcttcttctctttgatctctgatggagacgttccgtgtttagtagcaagggttagttgaggccttgtgtttggaaacgtacggtgtcgttttggagttgggaaaacaaataattctgagagatggcaaccacgaacccttttgatttgttgggtgacgacgctgaggacccttctcagctcatcgccgccgagcaactcaaggcggcggctgctgctgcggctgccaccgccgctcccaagaaggcgccggctcagcagatcaagccggctcagctccc

SEQ ID NO: 3568 - DNA, 396 bp, Glycine max
attatattctctcactctcttactctttcactctacttctctctcctattgcggctagggtttaggtgtttctttcaccgtctccgttccttcaatcttcttattctctttcatctctgatggagacgttgcgggtttagttctaaggggtggttctggccttgggtttttggaacgtacggtgtcgttttggggttgggaaaacaaattctgagagatggcaaccacgaacccttttgatttgttgggtgacgacgctgaggacccttctcagctcatcgccgccgagcaactcaaggcggcggctgcggcctcggctgccacctgggctcccaagaaggcgccggctcagcataacaagccggctcagctccctaccaagccgtcttcttcggc

SEQ ID NO: 3569 - DNA, 265 bp, Glycine max
ctcgagccgtccggtttctccattcaacgatttgcgatgtgaatcgatcattcattaacgatctttcaaggaaatattcgttgcgatcggtgattctgttgttgttattgaaaccacaatgcggggctatggcgatgaaggagatggttacgatgattattatgaggatgaagatgagtatgaagaggaggctgaggaagagtatgaagaagaggaagaggcgcctaggaagccttcaaaagaagaaatggagtaccttgagttg

SEQ ID NO: 3570 - DNA, 282 bp, Glycine max
ccgtctttatgtccctttatttttttgagggttaaaaactgctgtgaaatatttttctaggattttggctaatcgtctatcagctgctcgctcaaaagagaggaagatgcggtacatttctgaattagagctcaaagtacaaacacttcagacagagacaaccacattgtctactcagtttaccaaattacaggtgtgtacggtctgagttgagccaatattcccttttcttcagttttccaatgatattttatggtgtcgaataatgtttgctcctagcat

SEQ ID NO: 3571 - DNA, 208 bp, Glycine max
tttatgtccctttatttttttgagggttaaaaactgctgtgaaatatttttctaggattttggctaatcgtctatcagctgctcgctcaaaagagaggaagatgcggtacatttctgaattagagctcaaagtacaaacacttcagacagagacaaccacattgtctactcagtttaccaaattacaggtgtgtaaggtctgagttga

SEQ ID NO: 3572 - DNA, 259 bp, Glycine max
gcctcatagctcctttctcatttcacacacactaagaagcatgagacatcatgaagattccaagttccaagcaactggttgtgggatttgcacttggaaatgaaggataggcaacgttggagagctgaagaggatgctttactacgcgcatatgtcaaacagtatggtcctagggaatggaatctggtgtctcagcgcatgaacacacctcttaacagggatgccaagtcatgcttagaaaggtggaagaactacctca

SEQ ID NO: 3573 - DNA, 405 bp, Glycine max
tacggctgcgagaagacgacagaaggggggtgccgtttattcatggaccagaagaatacatcatagcttctttctcatttcacacacacaagaaccttgagacatcatgaagatttcaagttccaagcaattggctgtgggatttgcacttggcaatgaaggataggcaacgttggagagctgaagaggatgctttacttcgtgcatatgtcaaacagtatggtcctagggaatggaatctcgtgtctcagcgcatgaacacacctcttaacagggatgccaagtcatgcttagaaaggtggaagaactacctcaaacccggcattaaaaaaggatctcttactgaggaagagcagcgtctagtcatcaatcttcaagcaacgcacgggaacaagtggaagaaaa

SEQ ID NO: 3574 - DNA, 396 bp, Glycine max
acccacgcgtccgtacggctgcgagaggacgacagaagggggccgttgtttcatggaccagaacaacgcctcatagctcctttctcatttcacacacacaaagaaccttgagacatcatgaagattccaagttccaagcaactggttgtgggatttgcacttggaaatgaaggatatgcaacgttggagagctgaagaggatgctttactacgcgcatatgtcaaacagtatggtcctagggaatggaatctggtgtctcagcgcatgaacacacctcttaacagggatgccaagtcatgcttagaaaggtggaagaactacctcaagcccggcattaagaaaggatctcttacagaggaagagcagcgtctagtcatcaaccttcaagcaacaca

SEQ ID NO: 3575 - DNA, 418 bp, Glycine max
agacgggtgcgagaagatgacagaagggggccgtttattcatggaccagaagaatacatcatagcttctttctcatttcacacacacaagaaccttgagacatcatgaagatttcaagttccaagcaattggctgtgggatttgcacttggaaatgaaggataggcaacgttggagagctgaagaggatgctttacttcgtgcatatgtcaaacagtatggtcctagggaatggaatctcgtgtctcagcgcatgaacacacctcttaacagggatgccaagtcatgcttataaaggtggaagaactacctcaaacccggcattaaaaaaggatctcttactgaggaagagcagcgtctagtcatcaatcttcaagcaacgcacgggaacaagtgggagaaaattgcagcacaagtcc

SEQ ID NO: 3576 - DNA, 271 bp, Glycine max
cggtgaacagctgtctccggaggtggagcgccggcctttcacggcggaggaagacgaggcgatcctgaaggctcacgccaggttcgggaacaagtgggccaccatcgcgcgcttcctcaatggccgcaccgacaacgccatcaagaaccattggaattccaccctcaagaggaagcgctccgagcctctctccgagcctcggcctctgaagagatccgccaccgtttcgggtagtcaatccggatccgatttgagcgattcgggtttaccc

SEQ ID NO: 3577 - DNA, 260 bp, Glycine max
actcgagccgaatcggctcgagatcggataaaagggccatggagacctgaagaggacgaagcgttacggaggttggttcaaccttacggccctaggaactggtccgttataagcaaatccattccgggtcggtctgggaaatcgtgccgcttgcggtggtgcaaccagctgtctccggaggtggagcgccggcctttcacggccgaggaagacgaggcgatcctgaaggctcacgccaggttcgggaacaagtgggccac

SEQ ID NO: 3578 - DNA, 431 bp, Glycine max
  unsure (1)..(431): unsure at all n locations
acgtcagcatggatcggataaaagggccatggagtcctgaagaggacgaagcgttacggaggttggttcagacttacggccctaggaactggtccgttataagcaaatccattccgggtcggtctgggaaatcgtgccgcttgcggtggtgcaacgagctgtctccggaggtggatcgccggcctttcacggcggaggaagacgatgcgatcctgaaggctcacgccaggttcgggaacaagtgggccaccatcgcgcgcttcctcaatggccgcaccgacaacgccatcaagaaccattggaattccaccctcaagaggaattgctccgagcctctctccgagcctcggcctctgaagagatccgccaccgtctcgggtagtcaatccggatccgatttgagcgaatcgggtttacccattantcttgca

SEQ ID NO: 3579 - DNA, 281 bp, Glycine max
ggggcttcgaacaaggagccccgaaacccaaaccctaatctgattcgctttcgattatggcgtctgagagcgcttctcgatcgagttccgcggccgattcgtacattgggagcttgataagcttgacctctaagagtgagatcagatacgaaggtattctctacaacatcaacaccgaagagtccagtattggcctcagaaacgtgcggtcttttggaacagaaggaaggaaaaaggatggcccacaaatccctcccagtgacaaggtttatgagtatata

SEQ ID NO: 3580 - DNA, 235 bp, Glycine max
cttcaaacaagaggccccaaaacccaaaccctattctggttcacttgcgattatggcgtctgagagcgcttctcgatcgagttccgcggccgattcgtacattgggagcttgataagcttgacctctaagagtgagatcagatacgaaggcatactctacaacatcaacaccgaagagtccagtattggcctcagaaacgtgcgatcttttggaacagaaggaaggaaaaaggat

SEQ ID NO: 3581 - DNA, 261 bp, Glycine max
agcgtctgagaccgcttctcggtcgagttccgcggctgattcgtacattgggagcttgataagcttgacctctaagagtgagatcagatacgaaggcattctctacaacatcaacaccgaagagtccagtattggcctcagaaatgtgcgatcttttggaacagaaggaagacaaaaggatggcccacaaattcctccaggtgacaaggtttatgagtatatacttttccgtgggactgacatcaaggatttacaggttaa

SEQ ID NO: 3582 - DNA, 256 bp, Glycine max
  unsure (1)..(256): unsure at all n locations
tgaagctcgaaaccgattagattagaggcttcaaacaagaggccccaaaacccnaaccctattctggttggcttgcgattatggcgtctgagagcgcttctcgatcgagttcagcggccgattcgtacattgggagcttgataancttgacctctaagagtgagatcagatacgaaggtattctctacaacatcaacaccgaagagtccagtattggcctcagaaacgtgcgatcttttggaacagaaggaaggaa

SEQ ID NO: 3583 - DNA, 264 bp, Glycine max
aaacaagacgccccaaaacccaaaccctattctggttggcttgcgattatggcgtctgagagcgcttctcgatcgagttcagcggccgattcgtacattgggagcttgataagcttgacctctaagagtgagatcagatacgaaggtattctctacaacatcaacaccgaagagtccagtattggcctcagaaacgtgcgatcttttggaacagaaggaaggaaaaaggatggcctacaaattcctccaggtgacaagatttat

SEQ ID NO: 3584 - DNA, 295 bp, Glycine max
tctgaattcggctctagcgagagttatcatatcttcatttaaggagccccgaaacccaaaccctaatctgattcgctttcgattatggcgtctgagagcgcttctcgatcgagttccgcggccgattcgtacattgggagcttgataagcttgacctctaagagtgagatcagatacgaaggtattctctacaacatcaacaccgaagagtccagtattggcctcagaaacgtgcggtcttttggaacagaaggaaggaaaaaggatggcccacaaatccctcccagtgacaagg

SEQ ID NO: 3585 - DNA, 273 bp, Glycine max
ctcgaccgcttcgaacaaggagccccgaaacccaaaccctaatctgattcgcttacgattatggcgtctgagagcgcttctcgatcgagttccgcggccgattcgtacattgggagcttgataagcttgacctcttcgagtgagatcagatacgaaggtattctctacaacgtcaacacttaagagtccagtattggcctcagaaacgtgcggtcttttggaacagaaggaaggaaaaaggatggcccacaaatccctcccagtggacaaggt

SEQ ID NO: 3586 - DNA, 226 bp, Glycine max
ggcgtctgagaccgcttctcggtcgagttccgcggctgattcgtacattgggagcttgataagcttgacctctaagagtgagatcagatacgaaggcattctctacaacatcaacaccgaagagtccagtattggcctcagaaatgtgcgatcttttggaacagaaggaagaaaaaaggatggcccacaaattcctccaggtgacaaggtttatgagtatatactt

SEQ ID NO: 3587 - DNA, 384 bp, Glycine max
gacccaagcgtcagcccacgcgtccgtacggctgcgagaagacgacagaagggggacaccgattagattaggggcttcgaacaaggagccccgaaacccaaaccctaatctgattcgctttcgattatggcgtctgagagcgcttctcgatcgagttccgcggccgattcgtacattgggagcttgataagcttgacctctaagagtgagatcagatacgaaggtattctctacaacatcaacaccgaagagtcgagtattggcctcagaaacgtgcggtcttttggaacagaaggaaggaaaaaggatggcccacaaatccctcccagtgacaaggtttatgagtatatacttttccgtgggactgacatcaaggatttacag

SEQ ID NO: 3588 - DNA, 228 bp, Glycine max
tttatatttccacattccatgtgaaccttctagaactataatagaaagaaaccttccattccatggctctgccgctcgaacataacggcgtttccattagcggtgactctcagagatccattcccacgccgtttctcaccaaaacttaccagctcgtctacgatcacaccctcgacgatgttatttcgtggaacgattctggatcgtccttcatcgtctggaacacca

SEQ ID NO: 3589 - DNA, 252 bp, Glycine max
accctccattccatggctccgccgctcgaacacaacggcgtttccacgagcggtgactctcagagatccattcccacgccgtttctcaccaaaacctaccagctcgtcgacgatcacaccatcgacgatgtcatttcgtggaacgattctggatcgtccttcatcgtctggaacaccacggggttcgccagggatttgcttcctaaatatttcaagcacaacaacttctccagcttcgttcgccaactcaac

SEQ ID NO: 3590 - DNA, 236 bp, Glycine max
aaaccctccattccatggctccgccgctcgaacacaacggcgtttccacgagcggtgactctcagagatccattcccacgccgtttctcaccaaaacctaccagctcgtcgacgtcacaccatcgacgatgtcatttcgtggaacgattctggatcgtccttcatcgtctggaacaccaccgctttcgccaaggatttgcttcctaaatatttcaagcacaacaacttctccagtt

SEQ ID NO: 3591 - DNA, 232 bp, Glycine max
ctctctctcttcttatatttccacattccacgtgaaccttctagaactataatagaaagaaacctccattccatggctccgccgctcgaacacaacggcgtttccacgagcggtgactctcagagatccattcccacgccgtttctcaccaaaacctaccagctcgtcgacgatcacaccatcgacgatgtcatttcgtggaacgattctggatcgtccttcatcgtctgga

SEQ ID NO: 3592 - DNA, 241 bp, Glycine max
cagagatccattcccacgccgtttctcaccaaaacctaccagctcgtcgacgatcacaccatcgacgatgtcatttcgtggaacgattctggatcgtccttcatcgtctggaacaccaccgctttcgccaaggatttgcttcctaaatatttcaagcacaacaacttctccagcttcgttcgccaactcaacacttatggatttagaaaagttgtacctgaccgctgggagttctcgaacg

SEQ ID NO: 3593 - DNA, 271 bp, Glycine max
gtgaaccttctagaactataatagacttatattccatggctccgccgctcgaacacaacggcgtttccaccagcggtgactctctgagatctattccgacgccgtttctcaccaaaaccttccaactcgtcgacgatcacaccatcgaccatgtgatttcgtggaacgattctggatcgtccttcatcgtctggaacaccacggctttcgccaaggatttgcttcctaaatatttcaagcgcaacaacttctccagcttcgttcgccaact

SEQ ID NO: 3594 - DNA, 255 bp, Glycine max
ctgaaccttctagaactataatagacttatattccatggcactgtcgctacaaacacaacgacgtttccaccagcggtgactctctgagatctattccgacgccgtttctcaccaaaaccttccaactcgtcgacgatcacaccatcgaccatgtgatttcgtggaacgattctggaatcaccttcatcgtctggactaccaccgctttcgccaaggatttgcttcctatataattcaaggggaacaacttctcc

SEQ ID NO: 3595 - DNA, 256 bp, Glycine max
accagcggtgactctctgagatctattccgacgccgtttctcaccaaaaccttccaactcgtcgacgatcacaccatcgaccatgtgatttcgtggaacgattctggatcgtccttcatcgtctggaacaccaccgctttcgccaaggatttgcttcctaaatatttcaagcacaacaacttctccagcttcgttcgccaactcaacacttatggattcagaaaagttgtacctgaccgctgggagttctcgaacg

SEQ ID NO: 3596 - DNA, 258 bp, Glycine max
atagacttatattccatggctccgccgctcgaacacaacggcgtttccaccagcggtgactctctgagatctattccgacgccgtttctcaccaaaaccttccaactcgtcgacgatcacaccatcgaccatgtgatttcgtggaacgattctggatcgtccttcatcgtctggaacaccaccgctttcgccaaggatttgcttcctaaatatttcaagcacaacaacttctccagcttcgttcgccaactcaacact

SEQ ID NO: 3597 - DNA, 292 bp, Glycine max
ggctcgacccacgcgtacgtacggctgcgagaagacgacagaaggggattccttttcctttctatctctctctcttcttatatttccacattccacgtgaaccttctagaactataatagaaagaaaccctccattccatggctccgccgctcgaacacaacggcgtttccacgagcggtgactctcagagattcattcccaagccgtttctcaacaaaacctaccagctcgtcgacgattacaccatcgacgatgtcaattcgtggaacgaatctggattgtccttcaacg

SEQ ID NO: 3598 - DNA, 275 bp, Glycine max
gaaaaatccaagaagtctgtgagcatcaccgagtttctgaagcctgctgagggggaagcatactataacccaggacgtggtaggggccgtggccgtggttcacgaggcggaggcggttaccatggaagtgccaccaacaatgcacctgctccatccattgaagatcccgggcatttcccaaccttgagtgccaagtgaggccttcccagaacccttttgacatatctctgtcctattttcaattttgggttctcttatttgaacttaagcaggaa

SEQ ID NO: 3599 - DNA, 227 bp, Glycine max
gaaaaatccaagaagtctgtgagcatcaccgagtttctgaagcctgctgagggggaagcatactataacccaggacgtggtaggggccgtggccgtggttcacgaggcggaggcggttaccatggaagtgccaccaacaatgcacctgctccatccattgaagatcccgggcatttcccaaccttgagtgccaagtgaggccttcccagaacccttttgacatatct

SEQ ID NO: 3600 - DNA, 240 bp, Glycine max
gaaaaatccaagaagtctgtgagcatcaccgagtttctgaagcctgctgagggggaagcatactataacccaggacgtggtaggggccgtggccgtggttcacgaggcggaggcggttaccatggaagtgccaccaacaatgcacctgctccatccattgaagatcccgggcatttcccaaccttgagtgccaagtgaggccttcccagaacccttttgacatatctctgtcctattttc

SEQ ID NO: 3601 - DNA, 239 bp, Glycine max
gaaaaatccaagaagtccgtgagcatcactgagtttctgaagcccgctgagggggaagcatactataacccagggcgtggtaggggtcgtggccgtggttcacgaggcggaggcggaggtgtttaccgtggaagttccacgaacaatgcacctgctccatccattgaagatcctgggcatttcccaaacttgggtgccaagtgaggccttgctagaacccttttgtcatatccctgtcc

SEQ ID NO: 3602 - DNA, 250 bp, Glycine max
tgagcatcactgagtttctgaagcctgctgagggggaagcatactataacccagggcgtggtaggggtcgtggccgtggttcacgaggtggaggcggaggcggaggtgtttaccgtggaagttccaccaacaatgcacctgctccatccattgaagatcctgggcatttcccaaacttgggcgccaagtgaggccttgctagaacccttttgtcatatccctgtcctattttcaattttgggttctctta

SEQ ID NO: 3603 - DNA, 238 bp, Glycine max
aagaaagacaatcatgacatattcattaaactgggatctgataaagataagcgaaaagaggcttttgagaaggaagaaaaatccaagaagtctgtgagcatcaccgagtttctgaagcctgctgagggggaagcatactataacccaggacgtggtaggggccgtggccgtggttcacgaggcggaggcggttaccatggaagtgccaccaacaatgcacctgctccatccattgaag

SEQ ID NO: 3604 - DNA, 244 bp, Glycine max
gaaaaagtgttggaagagagaaggaaggccttccaagcactcaagactgaagagagaaaggtggacactaaagagtttgaatccatgcaggccttatcaagcaagaaagataatcatgacatattcattaaactgggatctgataaagataagcgaaaagaggcttttgagaaggaagaaaaatccaagaagtccgtgagcatcactgagtttctgaagcctgctgagggggaagcatactata

SEQ ID NO: 3605 - DNA, 371 bp, Glycine max
acgtacggctgcgagaagacgacagaaggggaaaaagtgttggaagagagaaggaaggccttccaagcactcaagactgaagagagaaaggtggacactaaagagtttgaatccatgcaggccttatcaagcaagaaagacaatcatgacatattcattaaactgggatctgataaagataagcgaaaagaggcttttgagaaggaagaaaaatccaagaagtctgtgagcatcaccgagtttctgaagcctgctgagggggaagcatactataacccaggacgtggtaagggccgtggccgtggttcacgaagcggaggcggttaccatggaagtgccaccaacaatgcacctgctccatccattgaaga

SEQ ID NO: 3606 - DNA, 339 bp, Glycine max
gtggacactaaagagtttgaatccatgcaggccttatcaagcaagaaagacaatcatgacatattcattaaactgggatctgagaaagataagcgaaaagaggcttttgagaaggaagaaaaatccaagaagtctgtgagcatcaccgagtttctgaagcctgctgagggggaagcatactataacccaggacgtggtaggggccgtggccgtggttcacgaggcggaggcggttaccatggaagtggcaccaagaatgcacctgctccatccattgaagatgccgggcatttcccaaccttgaggtgccaagtgaagccttcccagaacgcttttgac

SEQ ID NO: 3607 - DNA, 252 bp, Glycine max
attgccattgggatggaggattcaaccattcacatctataatgtcagagtcgatgaggtgaaatcaaaattgaaaggccaccagaagcgtattactggtttagctttttctatgaatcttaacatactggtctcatctggtgctgatgctcatctttgtgtgtggagtatagacacatgggagaaaagaaaatcaattccaatacagctacccgcaggaaagtcacctgttggtgatacacgagtacagttc

SEQ ID NO: 3608 - DNA, 275 bp, Glycine max
tgaagccggtttacttgctctacgagaacgccgaatgaaggtgactcatgccgactttaagaaggccaaggataaagtgatgtttaagaagaaagaaggggtgcctgaagggctgtatatgtgaaatactatcctctatcatcctcgctcctcctgtctttttttcaatgttctagttatgcgaacaaatgataattcatttgtattatgcgaacaaatgtcagttttatttggaggcttgaatctcaacaacgatttaatcaatatagttttct

SEQ ID NO: 3609 - DNA, 277 bp, Glycine max
  unsure (1)..(277): unsure at all n locations
atttcctcttcctgatatcaaaacaaggagacgcatctttcagatacacacatcgaggatgacattagctgatgatgtcaacttggaagaatttgttatgactaaagatgaattctctggagctgatataaaggcaatatgtactgaagccggtttacttgctctacgagaacgccgaatgaaggtgactcatgccgcctttaagaaggccaaggataaagtgatgtttaagaagaaagaaggggtgcctgaagggctgtatatnnnnntactatcc

SEQ ID NO: 3610 - DNA, 260 bp, Glycine max
ggagacgcatcttccagatacacacgtcaaggatgacattagctgatgatgtcaacttggaagaatttgttatgactaaagacgaattctccggagctgatataaaggcaatatgtactgaagctggtttacttgctctacgagaacgtcgaatgaaggtgactcatgccgactttaagaaggccaaggataaagtgatgtttaagaagaaagaaggggtgcctgaagggctgtatatgtgaaaaacatccctattatct

SEQ ID NO: 3611 - DNA, 260 bp, Glycine max
  unsure (1)..(260): unsure at all n locations
ggagacgcatcttccagatacacacgtcaaggatgacattagctgatgatgtcaacttggaagaatttgttatgactaaagacgaattctccggagctgatataaaggcaatatgtactgaagctggtttacttgctctacgagaacgtcgaatgaaggtgactcatgccgactttaagaaggccaaggataaagtgatgtttaagaagaaagaaggggtgcctgaagggctgtatatgtgaaaactancctctattatc

SEQ ID NO: 3612 - DNA, 258 bp, Glycine max
ctcgagccgctctccctgatattaaaacaagaagacgcattttccagatacacacatcaaggatgacattagctgatgatgtcaatttagaagaatttgttatgaccaaggatgagttctctggagctgatataaaagcaatatgtactgaagctggcttacttgctttacgagaacgccgaatgaaggtgacgcatgccgactttaagaaggcaaaggataaagttatgtttaagaagaaagaaggagtgcccgaag

SEQ ID NO: 3613 - DNA, 257 bp, Glycine max
gtcaacttggaagaatttggtatgactaaagacgaattctccggagctgatataaaggcaatatgtactgaagctggtttacttgctctacgagaacgtcgaatgaaggtgactcatgccgactttaagaaggccaaggataaagtgatgtttaagaagaaagaaggggtgcctgaagggctgtatatgtgaaaaactatcctctattatctctggccctcttgtctttcttttaacgttctagttatgcgaacaaa

SEQ ID NO: 3614 - DNA, 266 bp, Glycine max
gtcaacttggaagaatttgttatgactaaagacgaattctccggagctgatataaaggcaatatgtactgaagctggtttacttgctctacgagaacgtcgaatgaaggtgactcatgccgactttaagaaggccaaggataaagtgatgtttaagaagaaagaaggggtgcctgaagggctgtatatgtgaaaaactatcctctattatctctggccctcttgtctttcttttaacgttctagttatgcgaacaaatgccaattc

SEQ ID NO: 3615 - DNA, 257 bp, Glycine max
ggaagattgaatttcctctccctgatatcaaaacaagaagacgcattttccagatacatacttcaaggatgacattagctgatgatgtcaacttagaagaatttgttatgactaaggatgagttctctggagctgatataaaagcaatatgtactgaagctggcttacttgctttacgagaacgccggatgaaggtgacgcatgccgacttcaagaaggcaaaggataaggttatgtttaagaagaaagaaggggtg

SEQ ID NO: 3616 - DNA, 257 bp, Glycine max
ctcgagccgattcggctcgaggaatttcctcttcctgatatcaaagcaaggagacgcatcagccagatacacacgtcaagactgacattagctgatgatgtcaacttggaagaatttgttatgactaaagacgaattctccggagctgatataaaggcaatatgtactgaagctggtttactaactctacgagaacgtcgaatgaaggtgactcatgccgactttaagaaggccaaggataaagtgatgtttaagaa

SEQ ID NO: 3617 - DNA, 202 bp, Glycine max
agatgatgtcaacttggaagaatttgttatgactaaagacgaattctccggagctgatataaaggcaatatgtactgaagctggtttacttgctctacgagaacgtcgaatgaaggtgactcatgccgactttaagaaggccaaggataaagtgatgtttaagaagaaagaaggggtgcctgaagggctgtatttgtgaaaa

SEQ ID NO: 3618 - DNA, 258 bp, Glycine max
tgatgatgtcaacttggaagaatttgttatgactaaagacgaattctccggagctgatataaaggcaatatgtactgaagctggtttacttgctctacgagaacgtcgaatgaaggtgactcatgccgactttaagaaggccaaggataaagtgatgtttaagaagaaagaaggggtgcctgaagggctgtatatgtgaaaaactatcctctattatctctggccctcttgtctttcttttaacgttctagttatgcg

SEQ ID NO: 3619 - DNA, 271 bp, Glycine max
aaccaacagaattgaaagtcttgatccagctttgctacgacctggtcgaattgacaggaagatagaatttcctcttcctgatatcaaaacaaggagacgcatcttccagatacacacgtcaaggatgacattagctgatgatgtcaacttggaagaatttgttatgactaaagacgaattctccggagctgatataaaggcaatatgtactgaagctggtttacttgctctacgagaacgtcgaatgaaggtgactcatgccgactttaag

SEQ ID NO: 3620 - DNA, 445 bp, Glycine max
ggagatgtaaaagtgattctggcaaccaacagaattgaaagtcttgatccagctttgctacggcctggtcgaattgacaggaagatagaatttcctcttcctgatatcaaaacaaggagacgcatctttcagatacacacatcgaggatgacattagctgatgatgtcaacttggaagaatttgttatgactaaagatgaattctctggagctgatataaaggcaatatgtactgaagccggtttacttgctctacgagaacgccgaatgaaggtgactcatgccgactttaagaaggccaaggataaagtgatgtttaagaagaaagaaggggtgcctgaagggctgtatatgtgaaatactatcctctatcatcctcgctcctcctgtctttttttcaatgttctagttatgcgaacaaatgataattcatttggattatgcg

SEQ ID NO: 3621 - DNA, 301 bp, Glycine max
gtactgaagctggtttacttgctctacgagaacgtcgaatgaaggtgactcatgccgactttaagaaggccaaggataaagtaatgtttaagaagaaagaaggggtgcctgaagggctgtatatgtgaaaaactatcctctattatctctggccctcttgtctttcttttaacgttctagttatgcgaacaaatgccaattcatttgtattctgcgaacaaatgtcagttgtattttaggggctttgaatctcaacaacgattttaattcaatatagttttctttcaatttcctcgatttc

SEQ ID NO: 3622 - DNA, 213 bp, Glycine max
tacggctgcgagaacgacagaaggggaggatcaaggttggtggcaaagctggtgctcttggtgacagtatcactgttacccgcgagaagaccaagatcattgtcacctctgacagtaacttttccaaacggtatttgaagtacttgacgaagaagtacttgaagaaacacaatgtgcgagactggctcagagtgattgcttcaaacaaggatg

SEQ ID NO: 3623 - DNA, 239 bp, Glycine max
tccatctgtcacaagagtttccctaccggtcaggccctgggtggccacaagcgctgccactacgacggcgggaacaaccacagtaacagcaacgccaacggaaacaacagcagcggcgccactacctccgacggcggcgctgcctcctcctcccacacgctccgtgggtttgacctgaaccttccggcgccgctgacggagttctggtcgccgatggggtttgatttcgggaagaagaa

SEQ ID NO: 3624 - DNA, 262 bp, Glycine max
gccagccaccgcaaggcctcgtcggaatccaaccccaccgcctccgtctctgccctagccaacgacagcgtttctgcttccaccgtcggcggcggaaggatgcacgagtgttccatctgtcacaagagtttccctaccggtcaggccctgggtggccacaagcgctgccactacgacggcgggaacatccacagtaacagcaacgccaacggaaacaacagcagcggcgccactacctccgacggcggcgctgcctcctcct

SEQ ID NO: 3625 - DNA, 267 bp, Glycine max
agtttccctaccggtcaggccctgggtggccacaagcgctgccactacgacggcgggaacaaccacagtaacagcaacgccaacggaaacaacagcagcggcgccactacctccgacggcggcgctgcctcctcctcccacacgctccgtgggtttgacctgaaccttccggcgccgctgacggagttctggtcgccgatggggtttgatttcgggaagaagaaggtaggcggtgaacaagaggtggaaagccgttgccggtaaccg

SEQ ID NO: 3626 - DNA, 252 bp, Glycine max
aatggatgcacgagtgttccatctgtcacaagagtttccctaccggtcaggccctgggtggccacaagcgctgccactacgacggcgggaacaaccacagtaacagcaacgccaacggaaacaacagcagctgcgccactacctccgacggcggcgctgcctcctcctcccacacgctccgtgggtttgacctgaaccttccggcgccgctgacggagttctggtcgccgatggggtttgatttcgggaaga

SEQ ID NO: 3627 - DNA, 254 bp, Glycine max
aaaatttgttacgggaaattattggttatcgcccagacattatttgtcttcaggaggttcaaagcgatcattatgacgaattcttttctcctgaactagacaaacatggatatcatggtctttacaagagaaaaacaaatgaggtgtacagtggcaacacaaatacaattgatgggtgtgcaacatttttccgtagagacagattttcacatgttaagaaatacgaggttgaatttaacaaggctgcacagtct

SEQ ID NO: 3628 - DNA, 245 bp, Glycine max
atcgcaggcaaaatttgttacgggaaattattggttatcgcccagacattatttgtcttcaggaggttcaaagcgatcattatgacgaattcttttctcctgaactagacaaacatggatatcatggtctttacaagagaaaaacaaatgaggtgtacagtggcaacacaaatacaattgatgggtgtgcaacatttttccgtatagacagattttcacatgttaagaaatacgaggttgaattt

SEQ ID NO: 3629 - DNA, 250 bp, Glycine max
ccactgcaaaggaacactcaagcttagcaactataactcttttgagggggttctttactgcaggccacacttcgaccaactgttcaaaagaactggtagtcttgacaaaagcttcgaagggacaccaaaaattgctaaaccagaaaaaaccggggaagagaaaactgcagcaaccaaagtctcaagtatgtttggtggaactagagataaatgtgccggttgtcaaaaaacagtgtatcccactgaaaag

SEQ ID NO: 3630 - DNA, 111 bp, Glycine max
gtgagagaataggaaaaagggaaatatggcatttgcaggaacaactcagaagtgcatggcttgtgacaaaacagtttatctggttgataagttgacagcagataaccgagt

SEQ ID NO: 3631 - DNA, 271 bp, Glycine max
gtgagagaataggaaaaagggaaatatggcatttgcaggaacaactcagaagtgcatggcttgtgacaaaacagtttatctggttgataagttgacagcagataaccgagtgtaccataaggcttgcttcagatgccaccactgcaaaggaacactcaagcttagcaactataactcttttgagggggttctttactgcaggccacacttcgaccaactgttcaaaagaactggtagtcttgacaaaagcttcgaaggacaccaaaaattg

SEQ ID NO: 3632 - DNA, 239 bp, Glycine max
gaacactctcgcttagcaactataactcttttgagggggttctttactgcaggccacacttcgaccaactgttcaaaagaactggtagtcttgacaaaagcttcgaagggacaccaaaaattgctaaaccagaaaaaaccggggaagagaaacctgcagcaaccaaagtctcaagtatgtttggtggaactagagataaatgtgccggttgtcaaaaaacagtgtatcccactgaaaag

SEQ ID NO: 3633 - DNA, 253 bp, Glycine max
ctcgagccgaatcggctcgaggtctcctcctcaatcttcattgtactgttctttcccttggcgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaagga

SEQ ID NO: 3634 - DNA, 249 bp, Glycine max
gtaattgtttggaagtttgctttagtctccgcaattttctgcttgcttcttcacttttttttcctttgtctcctcctcaatcttcattgtcctgttcttcccctaggtgacacacacacgcagatatcatagcttgtgttagtgaggttagaagataaagaaagaatggcatttgcaggaacaacccagaagtgtatggcctgcgacaaaacggtttatctggttgataagttgaccgcggataaccga

SEQ ID NO: 3635 - DNA, 223 bp, Glycine max
ctcctcctcaatcttcattgtcctgttctttcccttggtgacaaaccaagactaacacacacagaacatagcttgtgttggtgaggtgagaagataaagaaagaatggcatttgcaggacaacacagaagtgtatggcctgtgacaaaaccgtttatctggttgataagttgaccgcggataaccgagttttccacaaagcttgcttcagatgccatcactgc

SEQ ID NO: 3636 - DNA, 256 bp, Glycine max
ctttggtaaggtgagagaataggaaaaagggaaatatggcatttgcaggaacaactcagaagtgcatggcttgtgacaaaacagtttatctggttgataagttgacagcagataaccgagtgtaccataaggcttgcttcagatgccaccactgcaaaggaacactcaagcttagcaactataactcttttgagggggttctttactgcaggccacacttcgaccaactgttcaaaagaactggtagtcttgacaa

SEQ ID NO: 3637 - DNA, 248 bp, Glycine max
cctctgtctcctcctcaatcttcattgtcctgatctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaaggacccctcaagct

SEQ ID NO: 3638 - DNA, 254 bp, Glycine max
gttctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaaggaaccctcaagctgagcaactacaactcttttgagggagttctttattgt

SEQ ID NO: 3639 - DNA, 265 bp, Glycine max
ctcctcaatcttcattgtcctgttcttcccctaggtgacacacacacgcagagatcatagcttgtgttagtgaggttagaagataaagaaagaatggcatttgcaggaacaacccagaagtgtatggcctgcgacaaacggtttatctggttgataagttgaccgcggataaccgagtgttccacaaagcttgcttcagatgccatcactgcaaaggaaccctcaagctgagcaactacaactcttttgagggagttctttactg

SEQ ID NO: 3640 - DNA, 266 bp, Glycine max
ctgcttttgtctcctgcctcccacatttcaccaccccctttatcattatctcctctcttcattgttctgctcttccccttaacaaacaataactctatttaaagcacacacaaagggatcatatatcttggttgcaccttggtaaggtgagaaaatatggcatttgcaggaacaactcagaagtgcatggcttgtgacaaaacagtttatctggttgataagctgaccgcagataaccgagtgtaccataaggcttgcttcagatg

SEQ ID NO: 3641 - DNA, 262 bp, Glycine max
ttcctctgtctcctcctcaatcttcattgtcctgttctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaaggaaccctcaagctgagcaactacaa

SEQ ID NO: 3642 - DNA, 259 bp, Glycine max
ctcctcaatcctcattgtcctgttcttcccctaggtgacacacacacgcagagatcatagcttgtgttggtgaggttacaagataaagaaagaatggcatttgcaggaacaacccagaagtgtatggcctgcgacaaaacggtttatctggttgataagttgaccgcggataaccgagtgttccacaaagcttgcttcagatgccatcactgcaaaggaaccctcaagctgagcaactacaactcttttgagggagttc

SEQ ID NO: 3643 - DNA, 280 bp, Glycine max
atttaaagcacacacaaagggatcatatatcttggttgcaccttggtaaggtgagaaaatatggcatttgcaggaacaactcagaagtgcatggcttgtgacaaaacagtttatctggttgataagttgaccgcagataaccgagtgtaccataaggcttgcttcagatgccaccactgcaaaggaacactcaagctcagcaactataactcttttgaaggagttctttactgcaggccacactttgaccaactgttcaaaatcactggtagtcttgaca

SEQ ID NO: 3644 - DNA, 271 bp, Glycine max
cgcttcttcacttttctttttcctctgtctcctcctcaatcttcattgtcctgttctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaaggaaccctcaagctga

SEQ ID NO: 3645 - DNA, 243 bp, Glycine max
aaatatggcatttgcaggaacaactcagaagtgcatggcttgtgacaaaacagtttatctggttgataagttgaccgcagataaccgagtgtaccataaggcttgcttcagatgccaccactgcaaaggaacactcaagctcagcaactataactcttttgaaggagttctttactgcaggccacactttgaccaactgttcaaaagaactggtagtcttgacaaaagcttcgaagggacacc

SEQ ID NO: 3646 - DNA, 262 bp, Glycine max
  unsure (1)..(262): unsure at all n locations
ttctgcttgcttcttcacttttttttttcctctgtctcctcctcaatcttcattgtcctgttntttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaa

SEQ ID NO: 3647 - DNA, 253 bp, Glycine max
ctcaatcttcattgtcctgttctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaaggaaccctcaagctgagcaactacaactcttt

SEQ ID NO: 3648 - DNA, 257 bp, Glycine max
ggttgctttagtctccgcaattttctgcttgcttcttcacttttttttttcctctgtctcctcctcaatcttcattgtcctgttctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaa

SEQ ID NO: 3649 - DNA, 265 bp, Glycine max
ctgtctcctcctcaatcttcattgtcctgttctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcacatgccatcactgcaaaggaaccctcaagctgagcaactacaactcttttg

SEQ ID NO: 3650 - DNA, 253 bp, Glycine max
tttcctctgtctcctcctcaatcttcattgtcctgttctttcccttggtgacaaaccaagactaacacacacagaacatagcttgtgttggtgaggtgagaagataaagaaagaatggcattgacaggaacaacacagaagtgtatggcctgtgacaaaaccgtttatctggttgataagttgaccgcggataaccgagttttccacaaagcttgcttcagatgccatcactgcaaaggaaccctcaagctga

SEQ ID NO: 3651 - DNA, 263 bp, Glycine max
gggaaatatggcatttgcaggaacaactcagaagtgcatggcttgtgacaaaacagtttatctggttgataagttgacagcagataaccgagtgtaccataaggcttgcttcagatgccaccactgcaaaggaacactcaagcttagcaactataactcttttgagggggttctttactgcaggccacacttcgaccaactgttcaaaagaactggtagtcttgacaaaagcttcgaagggacaccaaaaattgctaaaccag

SEQ ID NO: 3652 - DNA, 258 bp, Glycine max
cggctgcgagaagacgacagaagggggcaccttggtaaggtgagaaaatatggcatttgcaggaacaactcagaagtgcatggcttgtgacaaaacagtttatctggttgataagttgaccgcagataaccgagtgtaccataaggcttgcttcagatgccaccactgcaaaggaacactcaagctcagcaactataactcttttgaaggagttctttactgcaggccacactttgaccaactgttcaaaagaactgg

SEQ ID NO: 3653 - DNA, 277 bp, Glycine max
tacggctgcgagaagacgacagaaggggatggaaggttgctttagtctccgcaattttctgcttgcttcttcacttttttttttcctctgtctccgcctcaatcttcattgtcctgatcttccccttggtgacagaccaagactagcacacagagaacatagcttgtgttgatgagatgcttaagataaagaaagaatggcatttgcaggaacaacacagaagtgtatggcctgtgacaaaaccgtttatctggttgatagttgaccgcggataacc

SEQ ID NO: 3654 - DNA, 270 bp, Glycine max
cggctgcgagagacgacagaaggggggttgcaccttggtaaggtgagaaaatatggcatttgcaggaacaactcagaagtgcatggcttgtgacaaaacagtttatctggttgataagttgaccgcagataaccgagtgtaccataaggcttgcttcagatgccaccactgcaaaggaacactcaagctcagcaactataactcttttgaaggagttctttactgcaggccacactttgaccaactgttcaaaagaactggtagtcttga

SEQ ID NO: 3655 - DNA, 286 bp, Glycine max
acggccgacagaaggggggttgcaccttggtaaggtgagaaaatatggcatttgcaggaacaactcagaagtgcatggcttgtgacaaaacagtttatctggttgataagttgaccgcagataaccgagtgtaccataaggcttgcttcagatgccaccactgcaaaggaacactcaagctcagcaactataactcttttgaaggagttctttactgcaggccacactttgaccaactgttcaaaagaactggtaatcttgacaaaagcttcgaaaggacaccaaa

SEQ ID NO: 3656 - DNA, 418 bp, Glycine max
tctgtctcctcctcaatcttcattgtcctgttctttcccttggtgacaaaccaagactaacacacacagaacatagcttgtgttggtgaggtgagaagataaagaaagaatggcatttgcaggaacaacacagaagtgtatggcctgtgacaaaaccgtttatctggttgataagttgaccgcggataaccgagttttccacaaagcttgcttcagatgccatcactgcaaaggaaccctcaagctgagcaactacaactcttttgagggagttctttattgtaagccacactttgaccaactgttcaaaagaacagggagccttgacaaaagctttgaaggaacaccaaaaattgccaagccagagaaaaatttggaagagaaacctgcagcagccaaagtctcaagtatgtttgga

SEQ ID NO: 3657 - DNA, 430 bp, Glycine max
tacggctgcgagaagacgacagaaggggggttgcactttggtaaggtgagagaataggaaaaagggaaatatggcatttgcaggaacaactcagaagtgcatggcttgtgacaaaacagtttatctggttgataagttgacagcagataaccgagtgtaccataaggcttgcttcagatgccaccactgcaaaggaacactcaagcttagcaactataactcttttgagggggttctttactgcaggccacacttcgaccaactgttcaaaagaactggtagtcttgacaaaagcttcgaagggacaccaaaaattgctaaaccagaaaaaaccggggaagagaaacctgcagcaaccaaagtctcaagtatgtttggtggaactagagataaatgtgccggttgtcaaaaaacagtgtatcccactgaa

SEQ ID NO: 3658 - DNA, 260 bp, Glycine max
atttctccaacgctatcgagccaaacccaaacgttaactcagaagaagaccagcagaagaagaagaagaagaaacaaaaccgaaccactttcaactctccaacgtcgccacacgattcatcgcgtttcgcaggctgcaatggcgacgttcgaactgtaccgcaggtcgacgatcggaatgtgcctgacggagacgctggacgagatggttcagacggcactctcagccccgagctcgcgattcaggttctggtccagttc

SEQ ID NO: 3659 - DNA, 289 bp, Glycine max
aaatttctccaacgctatcgagccaaacccaaacgttaactcagaagaagaccagcagaagaagaagaagaagaaacaaaaccgaaccactttcaactctccaacgtcgccacacgattcatcgcgtttcgcaggctgcaatggcgacgttcgaactgtaccgcaggtcgacgatcggaatgtgcctgacggagacgctggacgagatggttcagaacggcactctcagccccgagctcgcgattcaggttctggtccagttcgataagtccatgactgaggctctgga

SEQ ID NO: 3660 - DNA, 274 bp, Glycine max
aatttctccaacgctatcgagccaaacccaaacgttaactcagaagaagaccagcagaagaagaagaagaagaaacaaaaccgaaccactttcaactctccaacgtcgccacacgattcatcgcgtttcgcaggctgcaatggcgacgttcgaactgtaccgcaggtcgacgatcggaatgtgcctgacggagacgctggacgagatggttcagaacggcactctcagccccgagctcgcgattcaggttctggtccagttcgataagtccatg

SEQ ID NO: 3661 - DNA, 351 bp, Glycine max
  unsure (1)..(351): unsure at all n locations
ttcgtggaggccgtggaggtggacgaggtgggggacgtggatttggacgtggatttggaccacgagttccttaccgtggtggtcgtcgtggaggtttcagcaatggtgaaactggtgaaggtgaagacggacgacctcgaagagcatttgatcgtcgcagtgggactggacgaggaaatgaattcaaacgngaaggttcaggacgaggtaactggggaacccaaactgatgaacttgctcaggtaactgatgaggttgtgaatgaaacggaaaagaatttgggtgatgagaagcctgcagttgaagaagatgtagctgatggaaacaaggacagccctactaatgnaaccg

SEQ ID NO: 3662 - DNA, 204 bp, Glycine max
  unsure (1)..(204): unsure at all n locations
aaatgagtctgttcgtggaggccgtggaggtggacgaggtgggggacgtggatttggacgtggtcgtgggtttagtcgtgactcttccaatgacgagaactcattccctaccagcggagtcncttataatcaggtttcttttgaaggagatgctgggaagtcttctgaaagacgcggttatngtggaccacgaggtccttaacc

SEQ ID NO: 3663 - DNA, 333 bp, Glycine max
  unsure (1)..(333): unsure at all n locations
ggatgccagaaacgagccagttcgtggaggccgtggaggtggacgaggtgggggacgtggatttggacgtggtcgtgggtttagtcgtgactcctcgaatgatgagaactcattccctaccagcagagctccttataatcagggtccttttgaagaaggagatgctgggaagtcttctgaaagacgcagttatggtggaccacgagttccttaccgtggtggtcgtcgtggaggtttcagcaatggtgaaactggtgaaggtgaagacggacgacctcgaagagcatttgatcgtcgcagtgggactggacgagganatgaattcaaacgtga

SEQ ID NO: 3664 - DNA, 242 bp, Glycine max
tgctgggaagtcttctgaaagacgcagttatggtggaccacgagttccttaccgtggtggtcgtcgtggaggtttcagcaatggtgaaactggtgaaggtgaagacggacgacctcgaagagcatttgatcgtcgcagtgggactacgacgaggaaatgaattcaaacgtgaaggttcaggacgaggtaactggggaacccaaactgatgaacttgctcaggtaactgatgaggttgtgaat

SEQ ID NO: 3665 - DNA, 256 bp, Glycine max
tggaacacgaggtccttaccgtggtggtggtggtcgtcgtggaggtttcagcaatggtgaaactggtgaagctgaagaaggacgacctcgaagagcatttgatcgtcgcagtgggactggacgaggaaatgaattcaaacgtgaaggttcaggacgtggtcaactggggagcccaaactgatgaacttgctcaggtaactgatgaggttgcgaatgaaactgaaaagaatttgggtgatgagaagcctgcagttga

SEQ ID NO: 3666 - DNA, 236 bp, Glycine max
gccagttcgtggaggccgtggaggtggacgaggtgggggacgtggatttggacgtggtcgtgggtttagtcgtgactcctcgaatgatgagaactcattccctaccagcagagctccttataatcagggtccttttgaagaaggagatgctgggaagtcttctgaaagacgcagttatggtggaccacgagttccttaccgtggtggtcgtcgtggaggtttcagcaatggtgaaa

SEQ ID NO: 3667 - DNA, 241 bp, Glycine max
  unsure (1)..(241): unsure at all n locations
cnagcctcttcctccggctcaggctgtgagggatgccagacatgagtctgttcgtggaggccgtggaggtggacgaggtgggggacgtggatttggacgtggtcgtgggtttagtcgtgactcttccaatgacgagaactcattccctaccagcggagtccttataatcaggtttcttttgaaggagatgctgggaagtcttctgaaanacgcggttatggtggnccacgaggttcttacc

SEQ ID NO: 3668 - DNA, 234 bp, Glycine max
cggatgccagacacgagccagttcgtggaggccgtggaggtggacgaggtgggggacgtggatttggacgtggtcgtgggtttagtcgtgactcctcgaatgatgagaactcattccctaccagcagagctccttataatcagggtccttttgaagaaggagatgctgggaagtcttctgaaagacgcagttatggtggaccacgagttccttaccgtggtggtcgtcgtggag

SEQ ID NO: 3669 - DNA, 267 bp, Glycine max
ctcgagcgatgctgggaagtcttctgaaagacgcggttatggtggaccacgaggtcattaccgtggtgcgtggtggtcgtcgtggaggtttcagcaatggtgaaactggtgaagctgaagaaggacgacctcgaagagcatttgatcgtcgcagtgggactggacgaggaaatgaattcaaacgtgaaggttcaggacgtggtaactggggagcccaaactgatgaacttgctcaggtaactgatgaggttgcgaatgaaactgaaa

SEQ ID NO: 3670 - DNA, 286 bp, Glycine max
gtggtcgtgggtttagtcgtgactcctcgaatgatgagaactcattccctaccagcagagctccttataatcagggtccttttgaagaaggagatgctgggaagtcttctgaaagacgcagttatggtggaccacgagttccttaccgtggtggtctcgtggaggtttcagcaatggtgaaactggtgaaggtgaagacggacgacctcgaagagcatttgatcgtcgcagtgggactggacgaggaaatgaattcaaacgtgaaggttcaggacgaggtaactgg

SEQ ID NO: 3671 - DNA, 279 bp, Glycine max
acggctgcgagagacgacagaaggggtccttttgaagaaggagatgctgggaagtcttctgaaagacgcagttatggtggaccacgagttccttaccgtggtggtcgtcgtggaggtttcagcaatggtgaaactggtgaaggtgaagacggacgacctcgaagagcatttgatcgtcgcagtgggactggacgaggaaatgaattcaaacgtgaaggttcaggacgagatatactggggaaccaaactgatgaacttgctcaggtaactgatgaggtt

SEQ ID NO: 3672 - DNA, 361 bp, Glycine max
  unsure (1)..(361): unsure at all n locations
ggttcgtggaggccgtggaggtggacgaggtgggggacgtggatttggacgtggtcgtgggtttagtcgtgactcctcgaatgatgagaactcattccctaccagcagagctccttataatcagggtccttttgaagaaggagatgctgggaagtcttctgaaagacgcagttatggtggaccacgagttccttaccgtggtggtcgtcgtggaggtttcagcaatggtgaaactggtgaaggtgaagacggacgacctcgaagagcatttgatcgtcgcagtgggactggacgaggaaatgaattcaaacgtgaaagttcaggacgangtaactggggaacccaaactgatgaacttgct

SEQ ID NO: 3673 - DNA, 349 bp, Glycine max
atacggctgcgagaagacgacagaagggggtcgtcgtggaggtttcagcaatggtgaaactggtgaaggtgaagacggacgacctcgaagagcatttgatcgtcgcagtgggactggacgaggaaatgaattcaaacgtgaaggttcaggacgaggtaactggggaacccaaactgatgaacttgctcaggtaactgatgaggttgtgaatgaaacggaatagaatttgggtgatgagaagcctgcagttgaagaagatgtagctgatggaaacaaggacagccctactaatgaaaccgacgaaaaagagcctgaagataaggaaatgactctggacgaatatgaaaaa

SEQ ID NO: 3674 - DNA, 261 bp, Glycine max
gggtttagtcgtgactcttccaatgacgagaactcattccctaccagcggagctccttataatcaggtttcttttgaaggagatgctgggaagtcttctgaaagacgcggttatggtggaccacgaggtccttaccgtggtggtggtggtcgtcgtggaggtttcagcaatggtgaaactggtgaagctgaagaaggacgacctcgaagagcatttgatcgtcgcagtgggactggacgaggaaatgaattcaaacgtgaa

SEQ ID NO: 3675 - DNA, 257 bp, Glycine max
gtttagtcgtgactcttccaatgacgagaactcattccctaccagcggagtccttataatcaggtttcttttgaaggagatgctgggaagtcttctgaaagacgcggttatggtggaccacgaggtccttaccgtggtggtggtggtcgtcgtggaggtttcagcaatggtgaaactggtgaagctgaagaaggacgacctcgaagagcatttgatcgtcgcagtgggactggacgaggaaatgaattcaaacgtga

SEQ ID NO: 3676 - DNA, 367 bp, Glycine max
cggaggagtttttcgttggatagttccatagggaactttaacattgaagatggattgcctaagcttcctccttcgaaaaatcaaatgggtcagcactcacctagcaattcgatggacggcaaaatgtcagaaacctccacggagtttggaaatggcgaatttagtgcagaggaggtaaagaaaataatggaaagtgataaactagctgaaattgcttcgactgatcccaaacgtgcaaaaaggattttggctaatcgtcaatcagctgctcgttcaaaggagaggaagatgcgatacattgctgaattggaacacaaagtgcaaactcttcagacagaaacaaccacattgtctactcagtttacca

SEQ ID NO: 3677 - DNA, 251 bp, Glycine max
aaaacttctcttgaatccaatatttataacttcaaacaacatcagtcaacagcaaagcctaagctagaagattttctgcagcgattagatggtattgagcagaggcagaaacaattgctgaacttctttgagaaggctcttcagaatcctacttttgttgaacatctttcacgcaaaatcgagtccatggatttatctgcatataagaaaaggcgattgcctcaggttgatcatgtgcaaccagttgccga

SEQ ID NO: 3678 - DNA, 279 bp, Glycine max
  unsure (1)..(279): unsure at all n locations
ctccaacgctatcgagccaaacccaaacgttaactcagacgaaggcanccaacagaagaagaaganacaanatcgaacctctctaaactctccaacgtcgccacccgattcatcgcatttcgcaggctgcaatggcgacgttcgaactgtaccgcaggtcgacgattggaatgtgcctgacggagacgctggacgagatggttcagaacggcactctaagccccgagctcgcgattcaggttctggtccagttcgataagtccatgactgaggctctgg

SEQ ID NO: 3679 - DNA, 206 bp, Glycine max
aatttctccaacgctatcgagccaaacccaaacgttaactcagacgaagcaccaacagaagaagaagaaacaaaaccgaacctctctaaactctccaacgtcgccacccgattcatcgcatttcgcaggctgcaatggcgacgttcgaactgtaccgcaggtcgacgattggaatgtgcctgacggagacgctggacgagatggtt

SEQ ID NO: 3680 - DNA, 260 bp, Glycine max
caaacccaaacgttaactcagacgaagcaccaacagaagaagaagaaacaaaaccgaacctctctaaactctccaacgtcgccacccgattcatcgcatttcgcaggctgcaatggcgacgttcgaactgtaccgcagtcgacgattggaatgtgcctgacggagacgctggacgagatggttcagaacggcactctaagccccgagctcgcgattcaggttctggtccagttcgataagtccatgactgaggctctgga

SEQ ID NO: 3681 - DNA, 254 bp, Glycine max
gttaactcagacgaagcaccaacagaagaagaagaaacaaaaccgaacctctctaaactctccaacgtcgccacccgattcatcgcatttcgcaggctgcaatggcgacgttcgaactgtaccgcagtcgacgattggaatgtgcctgacggagacgctggacgagatggttcagaacggcactctaagccccgagctcgcgattcaggttctggtcccgttcgataagtcgctgactgagggtcctggaacgc

SEQ ID NO: 3682 - DNA, 414 bp, Glycine max
cccaaacgttaactcagacgaagcaccaacagaagaagaagaaacaaaaccgaacctctctaaactctccaacgtcgccacccgattcatcgcatttcgcaggctgcaatggcgacgttcgaactgtaccgcaggtcgacgattggaatgtgcctgacggagacgctggacgagatggttcagaacggcactctaagccccgagctcgcgattcaggttctggtccagttcgataagtccatgactgaggctctggaaacgcaagttaagagtaaggtctccatcaagggacatctccatacatatagattttgtgacaatgtttggaccttcatcttacaagatgctttgttcaagagcgaagacagccaagagattgttggacgggttaaaatagtggcgtgtgactcgaag

SEQ ID NO: 3683 - DNA, 257 bp, Glycine max
cttttctcttaatggaatgatggaacacaacatcatcgtcaacaacaacgtgatcgcaccgtttgtcataaaaacctacaatatggtgaacgatcccaccaccgataaactcatcacgtggggcccagccaacaacagcttcatcgtcctcgatcccctcgacttctcccactccctcctccctactttcttcaagcacaacaacttctccagcttcgttcgccaatcaacacctatggtttcagaaaggtggatcc

SEQ ID NO: 3684 - DNA, 225 bp, Glycine max
  unsure (1)..(225): unsure at all n locations
cttttctcttaatggnatgatggaacacaacatcatcgtcaacaacaacgtgatcgcaccgtttgtcataaaaacctacaatatggtgaacgatcccaccaccgataaactcatcacgtggggcccagccaacaacagcttcatcgtcctcgatcccctcgacttctcccactccctcctccctactttcttcaagcacaacaacttctccagcttcgttcgcca

SEQ ID NO: 3685 - DNA, 240 bp, Glycine max
cttttctcttaatggaatgatggaacacaacatcatcgtcaacaacaacgtgatcgcaccgtttgtcataaaaacctacaatatggtgaacgatcccaccaccgataaactcatcacgtggggcccagccaacaacagcttcatcgtcctcgatcccctcgacttctcccactccctcctccctactttcttcaagcacaacaacttctccagcttcgttcgccaactcaacacctatgg

SEQ ID NO: 3686 - DNA, 246 bp, Glycine max
agttaacgagtatggtaggtcatcctcagcgccaagacatattcataggactccggtagctgttcaggccctcccagttcaatctcaggcattgggaccacaggaaaattcaataactaatttgaatagttccttgctacctagcaattcctctgctgctcctcatatttctttgtccaaccctgcctctgtagatactttgaatgccatactaagtgatacggaaagacaacaacatttttctcg

SEQ ID NO: 3687 - DNA, 251 bp, Glycine max
agttaacgagtatggtaggtcatcctcagcgccaagacatattcataggactccggtagctgttcaggccctcccagttcaatctcaggcattgggaccacaggaaaattcaataactaatttgaatagttccttgctacctagcaattcctctgctgctcctcatatttctttgtccaaccctgcctctgtagatactttgaatgccatactaagtgatacggaaagacaacaacatttttctcgaactc

SEQ ID NO: 3688 - DNA, 243 bp, Glycine max
atggcagatcatcctcagcaccaagacatattcataggactccggtagctgttcaggccctcccagtccaatctcaggcattgggaccacagcaaaattcaataactaatttgaatagttccttgctacctagcaattcctctgctactcctcatatttctttgtccaaccctacctctgtagatactttgaatgccatactaagtgatacggaaagacaacaacatttttctcgaaccccaa

SEQ ID NO: 3689 - DNA, 246 bp, Glycine max
cacaggaggagcttcctgtttccatttcctctcacaaaaatcacgtattatgaacacacgaaaagacatggaccggatcaaaggcccatggagcccggaggaggacgaggctctgcagaagctggtggagaaacacgggcccaggaactggtccctcatcagcaagtccatcccgggccgctccggcaagtcctgcaggctccgctggtgcaaccactgtcccccaggtggagcacgggccttcac

SEQ ID NO: 3690 - DNA, 299 bp, Glycine max
  unsure (1)..(299): unsure at all n locations
acaggagtcgcctcgtgtttccgtttccgtttcaatttcctctcacaggctttaancttancagctcnagataaganatggancggatnaaaggcccatngagtcnggaggaggacgaggctctgcagaagctngtggagaaagcgggcccagganctggtctctgatcagcaagtccatcccgggccggtccggcaagtcctgcaggctccggtggtgcaaccagctgtccccccaggtggagcacngggccttcacggcgaagaggacgacaccataatccgggcccatgcncgttc

SEQ ID NO: 3691 - DNA, 259 bp, Glycine max
caggaggagcttcctgtttccatttcctctcacaaaaatcacttattatgaacacacgaaaagacatggaccggatcaaaggcccatggagcccggaggaggacgaggctctgcagaagctggtggagaaacacgggcccaggaactggtccctcatcagcaagtccatcccgggccgctccggcaagtctgcaggctccgctggtgcaaccagtgtccccccaggtggagcaccgggcttcacccacgaagaggacga

SEQ ID NO: 3692 - DNA, 198 bp, Glycine max
gggccacaggagtcgcctcgtgtttccgtttccgtttcaatttcctctcacaggctttaaccttaccagctcgagataagacatggaccggatcaaaggcccatggagtccggaggaggacgaggctctgcagaagctggtggagaaacacgggcccaggaactggtctctgatcagcaagtccatcccgggccggtc

SEQ ID NO: 3693 - DNA, 278 bp, Glycine max
cgacgagttcggcgtcgaacggtggtggtaggacccacgagtgctccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttaccagtcctcatccatccaagaagtcccgtttcaatttg

SEQ ID NO: 3694 - DNA, 279 bp, Glycine max
  unsure (1)..(279): unsure at all n locations
agcataagcacaagcacaagcacaagcacttctctaattccctttcacactctattacagatttcacaagtgcttacacttcaaatggctttggaagctcttcaatcacccaccanngncactccatcgtttagtccctttgangannccagttctcagttacttagagacaccgtggacgaaaggaaagcgttctaagcgtagccggcacggagcaacaactgcaacacccttcatgcaccgaggaagagtacctcgctctttgtctcatcatgntcg

SEQ ID NO: 3695 - DNA, 272 bp, Glycine max
cacaagcacaagcacttctctaattccctttcacactctattacagatttcacaagtgcttacacttcaaatggctttggaagctcttcaatcacccaccagagccactccatcgtttagtccctttgatgataccagtctcagttacttagagacaccgtggacgaaaggaaagcgttctaagcgtagccgcacggagcaacaactgcaacacccttcatgcaccgaggacgagtacctcgctctttgtctcatcatgctcgctcgcggcg

SEQ ID NO: 3696 - DNA, 253 bp, Glycine max
ctgctgtctccgacaacaattccgcgccgctacccgccgccaaactgagctacaaatgttcggtctgcaacaaagccttctcctcttaccaagcactcggtggacacaaggccagccaccggaagctcggcggcgagcaccactcgacctcctccgccgtgacaacgagttcggcgtcgaacggcggtgctaggacccacgagtgctccatctgccaaaagacgttcccaacaggacaggccttgggaggaca

SEQ ID NO: 3697 - DNA, 302 bp, Glycine max
cttcaaatggctttggaagctcttcaatcacccaccacagccactccatcgtttagtccctttgaagaaaccagtctcagttacttagagacaccgtggacgaaaggaaagcgttctaagcgtaccgcacggagcaacaactgcaacacccttcatgcaccgaggaagagtacctcgctctttgtctcatcatgctcgctcgcggcggacgcggcagtgtctccaccgccaaacccgctgtctccgacaacaattctgcgccgctatccgccgccaaactgagctacaaatgttcggtttgc

SEQ ID NO: 3698 - DNA, 267 bp, Glycine max
  unsure (1)..(267): unsure at all n locations
ctcttaccangcactcggtggacacaaggccagccaccggaagctcggcggcgagcaccacttcgacctcctccgccgtgacaacgagttcggcgtcgaacggcggtgctaggacccacgagtgctccatctgccaaaagacgttcccaacaggacaggccttgggnggacacaaacgttgtcactacgaaggcggtaacngcgccgtaaccgcctctganggagtggggtccactcacacaggaagccaccgcgatttcgatctga

SEQ ID NO: 3699 - DNA, 270 bp, Glycine max
  unsure (1)..(270): unsure at all n locations
cacaagcacaagcacaagcacttctctaattccctttcacactctattacagatttcacaagtgcttacacttcaaatggctttggaagctcttcaatcacccaccacacccactccatcgtttagtccctttgaagataccagtctcagttacttagagacaccgtggacgataggaaagcgttctaagcgtagcgcacggtgcaacaactgcaacacccttcatgcaccgaggaagagtacctcgctctttgtctnctcatgctcgct

SEQ ID NO: 3700 - DNA, 272 bp, Glycine max
caaaagcaaccacaacaagcacttctcttatttcctatcacaccctattacagattcacaagcgcagacacttcaaatggctctggaagctcttcaatcacccagaacagccactccatcgtttagtccctttgaagaaaccaacctcagttacttggagacaccgtggaccaaaggaaagcgttctaagcgtagcgcatggagcagcaactgcaacactcttcatgcaccgaggaagagtacctcgctctctgtctcatcatgctcgctca

SEQ ID NO: 3701 - DNA, 441 bp, Glycine max
agtacggctgcgagaagacgacagaaggggctcactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagcct

SEQ ID NO: 3702 - DNA, 423 bp, Glycine max
cgggccgacccacgcgtcagtacagctgcgagaagacgacagaaggggactcaaaattaaccacaagcataagcacaagcgcaagcacaagcacttctctaattccctttcacactctattacagatttcacaagtgcttacacttcaaatggctttggaagctcttcaatcacccaccacagccactccatcgtttagtccctttgaagaaaccagtctcagttacttagtgacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaac

SEQ ID NO: 3703 - DNA, 429 bp, Glycine max
  unsure (1)..(429): unsure at all n locations
attaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccanaaccgctgtctccgacaacaattctgcgccgctatccgccggcaaactgagctacaaatgttcggtttgcaacaaagccttctcctcttaccaagcactcggaagaca

SEQ ID NO: 3704 - DNA, 413 bp, Glycine max
acaaagccttttcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttaccagtcctcatccatccaagaagtcccgtttcaatttgaccatacccaagattgaaatccctcaatactgatccatagat

SEQ ID NO: 3705 - DNA, 409 bp, Glycine max
cataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactc

SEQ ID NO: 3706 - DNA, 428 bp, Glycine max
gtacctcgctctctgtctcatcatgctcgctcacggcggcgccggcggtgtccccgccgccaagcctgctgtctccgacaacaattccgcgccgctacccgccgccaaactgagctacaaatgttcggtctgcaacaaagccttctcctcttaccaagcactcggtggacacaaggccagccaccggaagctcggcggcgagcaccactcgacctcctccgccgtgacaacgagttcggcgtcgaacggcggtgctaggacccacgagtgctccatctgccaaaagacgttcccaacaggacaggccttgggaggacacaaacgttgtcactacgaaggcgggaacagcgccggaaccggcttttgaggaatggggttcacttacacagggagccccccggatttcgaattggaacctccgggttttt

SEQ ID NO: 3707 - DNA, 437 bp, Glycine max
agtacggctgcgagaagacgacagaagggactcactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaa

SEQ ID NO: 3708 - DNA, 428 bp, Glycine max
  unsure (1)..(428): unsure at all n locations
cccacgcgtccgtacggctgcgagacgacagaaggggactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgncgtcaaactgagctacaaatgttc

SEQ ID NO: 3709 - DNA, 386 bp, Glycine max
caagcataagcacaagcacaagcacaagcacttctctaatgtccgtttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaa

SEQ ID NO: 3710 - DNA, 351 bp, Glycine max
caagcataagcacaatcacaagcacaagctcttctctaaggccggctcacactctattacagatttcacaagtgcttacacttcaaatggctttggaagctcttcaatcacccaccacagccactccatcgtttagtccctttgaagaaaccagtctcagttacttatagacaccgtggacgaaatgaaagcgttctaagcgtagccgcacggatcaacaactgcaacacccttcatgcaccgtataatagtacctcgctctttgtctcatcaatgctcgctcgcggcggcgcccacagtgtcttcaccgtcaaaccctctgtctacgacaacaattcttctccgatatcc

SEQ ID NO: 3711 - DNA, 374 bp, Glycine max
  unsure (1)..(374): unsure at all n locations
aaaccagtctcagttacttagagacaccgtggacgaaaggaaagggttctaagcgtagcccgacggagcaacaactgcaacacccttcatgcaccgaggaagagtacctcgctctttgtctcatcatgctcgctcgcggcggcgccggcagtgtctccaccgncaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgc

SEQ ID NO: 3712 - DNA, 242 bp, Glycine max
  unsure (1)..(242): unsure at all n locations
caaaaactacgtcaaaacgcgaactccgacgcaggttgccagccatgctcagaagtactttctccgacgacgccgctcctcagaactccgggcgccaccgcgagcgcgagcgaaagcgangagttccgtggacggaggaagaacacaagttgtttttggttggattgcagaaagtagggaaaggtgattggagaggaatctccaaaaactacgtcaaaacgcgaactccgacgcaggttgcc

SEQ ID NO: 3713 - DNA, 250 bp, Glycine max
caacctctcacagtacgaacatcctttagacgccaccaccaccaacaacaacaaagacgccgtcgccgccggctacgcctccgccgacgacgccgctcctcagaactccgggcgccaccgcgagcgcgagcgaaagcgaggagttccgtggacggaggaagaacacaagttgtttttggttggattgcagaacgtagggaaaggtgattggagaggaatctccaaaaactacgtcaaaacgcgaactccg

SEQ ID NO: 3714 - DNA, 272 bp, Glycine max
  unsure (1)..(272): unsure at all n locations
ctcaccttcaccttcaactgccaactgcaaanatctatcttctttcgggttcacttgaccgagagtaagagactaatccctcgagatactgatactgnaacctatcgttcttcacatcataaccattccgttccagcaacgtgcatcangcagcagagcctccaatgctaacactgggcgccaccctgtgtaccgtggagtgaggcgtaggagtagtggcaaatgggtttctgaaatccgtgaacccaaaaaacctaacaggatttggttag

SEQ ID NO: 3715 - DNA, 257 bp, Glycine max
caccttcaactgccaactgcaaatatctatcttctttcgggttcacttgaccgagattaagagactaatccctcgagatactgatactgaaacctatcgttcttcacatcataaccatgcgttccagcaacggtgcatcaagcagcagagcctccaatgctaacactgggcgccaccctgtgtaccgtggagtgaggcgtaggagtagtggcaaatgggtttctgaaatccgtgaacccaaaaaacctaacaggatt

SEQ ID NO: 3716 - DNA, 262 bp, Glycine max
ctatcttctttcgggttcacttgaccgagagtaagagactaatccctcgagatactgatactgaaacctatcgttcttcacatcataaccatgcgttccagcaacggtgcatcaagcagcagagcctccaatgctaacacagggcgccaccctgtgtaccgtggagtgaggcgtaggagtagtggcaaattggtttctgaaatccgaggacccaataaacctaacaggatttggttagggaatttgccacacctgaaatggc

SEQ ID NO: 3717 - DNA, 260 bp, Glycine max
gcgtgtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattgccacaga

SEQ ID NO: 3718 - DNA, 240 bp, Glycine max
gtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgtt

SEQ ID NO: 3719 - DNA, 341 bp, Glycine max
gaaacaatgcgaggagttggtggcgtttcttagagactcgctgaacgtgagccccgatgtgatagagcgcatcattcggcaaagaacgtgtgtgtccagcaacaatgatgcggtgcgttttgatgctattattaataatgatcttgatgacgacgaaaatgcggtaggtgagtgtgaaccacaacaaccaccacccaaaggtgacaatggagaaagtttgaaactatttggggtttggttgaagggtcaaaatgggaaagagattcaattggtaaatgccgcaagagagggcgccaagactaccctattgctgccactgccaaggaattgaagaccctagt

SEQ ID NO: 3720 - DNA, 213 bp, Glycine max
gagaaattgaagaaggacaacgagaaattgagcggcgagttagcgctggcgaagaaacaatgcgaggagttggtggcgtttcttagagactcgctgaacgtgagccccgatgtgatagagcgcatcattcggcaaggaacgtgtgtgtccagcaacaatgatgcggtgcgttttgatgctattattaataatgatcttgatgacgacgaaaat

SEQ ID NO: 3721 - DNA, 272 bp, Glycine max
tggaaacgaaggacgacagtgctgaaaacgaagaagcttggtcttctcatgaagacgaaattcttttgaactatgttcaagtccgtggagaaggaaattggagaaaccttcctaaaagagctggcttgaaacgatgtggtgagagttgcaaacaacgatggttgaactatcttaagccaaccatatctagaggaaacatttctttagatgaacatgaactcataatcagactgcataagctcttggggaatagatggtctatcattgctgga

SEQ ID NO: 3722 - DNA, 258 bp, Glycine max
caaggcattgattctggttggggggtttggaacaaggctgaggccactgacactcagttttcctaagcctcttcttgattttgctaacaaacctatgattctgcatcagatagaggcccttaaggccattggagttactgaggtggtgctagccatcaactaccaaccagaggttatgttgaatttcttgaaggattttgaaacaaagctcggcatcaagatcacatgttctcaggaaactgaaccatcgggaacagc

SEQ ID NO: 3723 - DNA, 231 bp, Glycine max
cagcctggcagaaagtatattatcaacaagtcactgatgttggcagagttggcttagacaatggttctggaaaatcactaagtctacagaacttgacaatgcaactcagaaaatgttgtaaccatccctacctctttgtgggtgactatgatatccataaacacaaggaggagattttcagagcatcaggaaagtttgaacttcttgaccgtttgcttccacacaacataa

SEQ ID NO: 3724 - DNA, 247 bp, Glycine max
  unsure (1)..(247): unsure at all n locations
cgaggatgttaggatgatatcagccgaagcaccagtcatctttgcaagggcatgtgaaatgttcatattagagttaaccctgcgttcttggaatcacactgaagagaacaaaaggcgaacacttcaaaaaaatgatttgctgctgcaatcacaaggactgacatctttgatttcttggttgacattgtgcctcgtgaggacttganagatgaagtgcttgcatcaatcccaagaggaacaatgcctg

SEQ ID NO: 3725 - DNA, 289 bp, Glycine max
gaacgaagggtttttggcggggcagaggcaattgttgaagacgataaagaggaggaggcacgtgacagtgacacagacacagtcacacgagggaggaagtggggcttgtgttgaattgggggagtttgggttggaaggtgagatggagaggtgaggagagacaggacagtgttgatggctgaaattgtgaggttgagacaacaacagcacaactcgagggagcaattgttgtccatggagactaggttgcaagccactgagaagaaacatcaacagatgatgaattttc

SEQ ID NO: 3726 - DNA, 224 bp, Glycine max
ctacggttttagaaaaattgatcctgacaagtgggagtttgcgaacgaagggtttttggcggggcagaggcaattgttgaagacgataaagaggaggaggcacgtgacagtgacacagacacagtcacacgagggaggaagtggggcttgtgttgaattgggggagtttgggttggaaggtgagatggagaggttgaggagagacaggacagtgttgatggctg

SEQ ID NO: 3727 - DNA, 263 bp, Glycine max
  unsure (1)..(263): unsure at all n locations
gcttcagtacttgctacctttctataaaggtagagagaagagaggacccttctcttgcatagttcaagtgagtgagagtgccaaaaaatgggaagggctcctngttgttccaaagtggggttgcacaaaggtccatggactcctaaagaagatgcattgcttaccaagtatatccaagctcatggagaaggccaatggaaatcactacccanaaaagcagggcttcttagatgtggaaaaagttgtagattgagatggatgaa

SEQ ID NO: 3728 - DNA, 264 bp, Glycine max
agaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcagggcttcttagatgtggaaaaagttgtagattgagatggatgaactatctgagaccagacataaagagagggaacatagc

SEQ ID NO: 3729 - DNA, 360 bp, Glycine max
aagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaa

SEQ ID NO: 3730 - DNA, 274 bp, Glycine max
gagctggcacaccacttcagaataatcttcatgaactctggtctcttctcaactttcttctgcccgaaatttttagttctgctgaaacttttgatgaatggtttcaaatctctggtgaaaatgaccaacaggaggttgttcaacaattacacaaggtcctccgcccatttctccttcgaaggttgaagtcagatggagagaaagggttgccaccgaaaaaggaaactattcttaaggtaggcatgtcccaaatgcagaaacagtattatagagc

SEQ ID NO: 3731 - DNA, 244 bp, Glycine max
ctgggctcttctcaactttcttttgcctgaaatatttagttctgctgaaacttttgatgaatggtttcaaatctctggtgaaaatgacgaacatgaggttgttcaacaactacacaaggtcctccgtccattcctccttcgaaggttgaagtcagatgttgagaaaggtttgccaccgaaaaaggaaaccattctcaaagtaggcatgtcgcaaatgcagaaacagtattataaggcattactg

SEQ ID NO: 3732 - DNA, 262 bp, Glycine max
cgacgctgaggacccttctcagctcatcgccgccgagcaactcaaggcggcggctgctgccgcggctgccaccgccgctccgaagaaggcgccggctcagcagatcaagccggctcagctccctagcaagcctcttacctccggctcaggctgtgagggatgccagacatgagtctgttcgtggaggccgtggaggtggacgaggtgggggacgtggatttggacgtggtcgtgggtttagtcgtgactcttccaatgacga

SEQ ID NO: 3733 - DNA, 264 bp, Glycine max
  unsure (1)..(264): unsure at all n locations
cgacgctgncggacccttctcagctcatcgccgccgagcaactcaaggcggcggctgcngcctcggcggccaccgcggctcccaagaaggcgccggctcagcagnacaagccggctcagctcnctaccaagccgcctcctccggctcaggctgtgagggatgccaganacgagccagttcgtggaggccgtggaggtggacgaggtgggggacgtggatttggacgtggtcgtgggtttagtcgtgantcctcgaatgatgaga

SEQ ID NO: 3734 - DNA, 238 bp, Glycine max
  unsure (1)..(238): unsure at all n locations
ctgctgctgcggctgccaccgccgctcccaaganggcgccggctcagcagatcaagccggctcagctccctagcaagcctcttcctccggctcaggctgtgagggatgccaannatgagtctgttcgtggaggccgtggaggtggacgaggtgggggacgtggatttggacgtggtcgtgggtttagtcgtgactcttccaatgacgagaactcattccctaccagcggagtccttat

SEQ ID NO: 3735 - DNA, 259 bp, Glycine max
agctaggaagtggtgttgtttttgtgttagtgctatgggaaggcaaccctgctgtgacaaacttggggtgaagaagggtccatggactgctgaggaagacaagaagctcatcaacttcattctcaccaatggccaatgctgttggcgcgccgtgccaaagctcgctggcctcaagcgctgtggcaagagttgtcgccttcgttggacgaattatcttcgtccagacttgaagagagggctactcacagaggcagaggag

SEQ ID NO: 3736 - DNA, 273 bp, Glycine max
gttggtgaagaaggacgcccaagaagagcatttgaacaccacagtgggactggacgaggaaatgaattcaaacgggatggctctggacgtgggaactggggtacacagaatgatgacattgctgtggttactgaggaagtggtgtatgaaactgaaaagaattttgctgatgagaagcctgcaggcgaggaagatgcacctgaaggaaacaaggactgtcctgccaatgaaaatgaagaaaaggagcctgaggacaaggagatgacactggaa

SEQ ID NO: 3737 - DNA, 195 bp, Glycine max
ggacgaggaaatgaattcaaacgggatggctctggacgtgggaactggggtacacagaatgatgacattgctgtggttactgaggaagtggtgaatgaaactgaaaagaattttgctgatgagaagcctgcaggcgtagaagatgcacctgaaggaaacaaggactgtcctgccaatgaaaatgaagaaaaggag

SEQ ID NO: 3738 - DNA, 264 bp, Glycine max
  unsure (1)..(264): unsure at all n locations
tggtggtcgcggtcgtcgtggaggttttaccaacggtgaagttggtgaagaaggacgcccaagaagagcatttgaacaccacagtgggactggacgangaaatgaattcaaacgggatggctctggacgtggganctggggtacacagaatgatgacattgctgtggttactgaggaagtggtgtatgaaactgaaaagaattttgctgatgagaagcctgcaggcgaggaagatgcacctgaaggaaacaaggactgtcctgc

SEQ ID NO: 3739 - DNA, 260 bp, Glycine max
tttgaaggggattctgggaatcactcagaaagacgtggttatggtggacctcgtgggccctaccgtggtggtagtggtggtcgcggtcgtcgtggaggttttaccaacggtgaagttggtgaagaaggacgcccaagaagagcatttgaacaccacagtgggactggacgaggaaatgaattcaaacgggatggctctggacgtgggaactggggtacacagaatgatgacattgctgtggttactgaggaaatggtgta

SEQ ID NO: 3740 - DNA, 262 bp, Glycine max
gtgggccctaccgtggtggtggtggtggtcgcggtcgtcgtggaggttttaccaacggtgaagttggtgaagaaggacgcccaagaagagcatttgaacaccacagtgggactggacgaggaaatgaattcaaacgggatggctctggacgtgggaactggggtacacagaatgatgacattgctgtggttactgaggaagtggtgtatgaaactgaaaagaattttgctgatgagaagcctgcacgaggaagatgcacctg

SEQ ID NO: 3741 - DNA, 290 bp, Glycine max
gaaagggccttggactcctgaagaagacatcatattggtgtcttatattcaggaacatggtcctggaaattggagggcagttcctgccaaaacagggttgtcaagatgcagcaagagttgcagacttagatggactaattacctgaggccaggaatcaaacggggcaacttcacagaacaagaggagaagatgataatccatcttcaagatcttttaggaaacagatgggctgcaatagcttcataccttccacagagaacagacaatcgacataaagaactattggaac

SEQ ID NO: 3742 - DNA, 248 bp, Glycine max
ggatgaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccaggaatcacacgtggtaacttcacagaacaagaggagcagatgataatccatcttcaagatct

SEQ ID NO: 3743 - DNA, 235 bp, Glycine max
gtaaagagggttagaggaataaaaagagaaagccgacagcacatagatagagagaggaaaacgacttaatattctttttccttgagacctgaaggggctaaggaaaattagaaggacacacaagtataaaggcggtgaaataaaagagaaagacaagaagaagacatgggaagaccaccttgttgtgacaaagaaggggtcaagaaagggccttggactcctgaagaagacatct

SEQ ID NO: 3744 - DNA, 251 bp, Glycine max
  unsure (1)..(251): unsure at all n locations
gtanagagggttagaggaataaaaagagaaagccgacagcacatagatagaganaggacaacgacttaatattctttttccttgagacctgaaggggctaaggaaaattagaaggacacacaagtataaaggcggtgaaataaaagagaaagacaagaagaagacatgggaagaccaccttgttgtgacaaagaaggggtcaaganagggccttggactcctgaagaagacattcatattggtgtcttaca

SEQ ID NO: 3745 - DNA, 255 bp, Glycine max
aagtaaagagggttagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagacgacatgggaagaccaccttgttgtgacaaagaaggggtcaagaaagggccttggactcatgaagaagacatcatatttgtgtcttatattc

SEQ ID NO: 3746 - DNA, 267 bp, Glycine max
gtaaagagggttagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagacgacatgggaagaccaccttgttgtgacaaagaaggggtcaagaaagggccttggactcctgaagaagacatcatattggagtcttatattcaggaacatggtcct

SEQ ID NO: 3747 - DNA, 239 bp, Glycine max
aaagagggttagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagacgacatgggaagaccaccttgttgtgacaaagaaggggtcaagaaagggccttggactcctgaagaagacatcatattgg

SEQ ID NO: 3748 - DNA, 238 bp, Glycine max
aaagagggttagagaaataaaaagagaaagccgacagcacatagatagagagaggaaaacgacttaatattcttttaccttgagacctgaaggggctaaggaaaattagaaggacacacaagtataaaggcggtgaaataaaagagaaagacaagaagacgacatgggaagaccaccttgttgtgacaaagaaggggtcaagaaagggccttggactcctgaagaagacatcatattg

SEQ ID NO: 3749 - DNA, 265 bp, Glycine max
  unsure (1)..(265): unsure at all n locations
aaagagggttagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagaagacatgggaagacaccttgttgtgacaaagaaggggtcaagaaagggccttggactcctgaagaagacatcatattggtgtcntatattcaggaacatggtcctg

SEQ ID NO: 3750 - DNA, 433 bp, Glycine max
  unsure (1)..(433): unsure at all n locations
cggacgcgtgggagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagaagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggactaattacctgaggccaggaatcaaacggngcaacttcacagaacaagaggagaagatgataatccatcttcaagatcttttaggaaacagatgggct

SEQ ID NO: 3751 - DNA, 450 bp, Glycine max
  unsure (1)..(450): unsure at all n locations
cccacgcgtccgtagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagaagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggactaattacctgaggccaggaatcaaacggngcaacttcacagaacangaggagaagatgataatccatcttcaagatcttttaggaaacagatgggctgcaatagcttcata

SEQ ID NO: 3752 - DNA, 262 bp, Glycine max
  unsure (1)..(262): unsure at all n locations
cgatcaactcaacacnaaccaaaactcaagctaaaattctcactctctctctacatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcgg

SEQ ID NO: 3753 - DNA, 199 bp, Glycine max
  unsure (1)..(199): unsure at all n locations
gcttaccaaaaaaatggctttggaaactctcaactcaccaacaacaancgccccatctttccccttcgacgacccanctattccatgggccaaaagaaaacgttcaaagcgttgttcacgcgaccacccttcggaggaagagtacctcgctctctgcctcatcatgctcnctcgcggcggcaccacccgccgcgtcaga

SEQ ID NO: 3754 - DNA, 257 bp, Glycine max
cgatcaactcaacacaaaccaaaactcaagctaaaattctcactctctctctcatctcgagatcatagtatcatcttcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagatgagtacctcgccctctgcctcatcatgctcgctc

SEQ ID NO: 3755 - DNA, 259 bp, Glycine max
ccaaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccg

SEQ ID NO: 3756 - DNA, 242 bp, Glycine max
attcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatca

SEQ ID NO: 3757 - DNA, 266 bp, Glycine max
cgaaaacgttcaaagcgttctcgcgaccatccttctgaagaagagtacctcgccctctgcctcatcatgctcgctcgcggcggcaccaccaccgtcaacaaccgccacgtcagccctccaccgccacagccacagccacagcgacaccagatccttccaccaagctcagttacaaatgctccgtttgcgacaagagcttcccctcttaccaagcgctcggtggacacaaggccagtcaccggaaactcgccgccgccgccgaagac

SEQ ID NO: 3758 - DNA, 253 bp, Glycine max
ggatcaactcaacacaaaccaaaactcaagctaaaattctcgctctctctctcatctcgagatcatagtatcatattcaatatcatttcataccaaacacatggctttggaagctctcaactcaccaacaacaaccgctccatcttttccctttgacgacccaactattccatgggcgaaacgaaaacgtgttcagcgttctcgcgaccatccttctgaagaagagtacctcgccctctgcctcatcatgctc

SEQ ID NO: 3759 - DNA, 238 bp, Glycine max
cacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatg

SEQ ID NO: 3760 - DNA, 253 bp, Glycine max
ccaacccaacccaaaactcaagctaaattctcactctcacaacttcaatctctttctctctctctctctctctctctcttccaaaaaaatggctttggaagctctcaactcaccaacaacaaccgccccactttccccttcgacgacccaactattccatgggccaaaagaaaacgttcaaagcgttgttcacgcgaccacccttcagaggaagagtacctcgctctctgcctcatcatgctcgctcgcggcg

SEQ ID NO: 3761 - DNA, 246 bp, Glycine max
ctcgatcaactcaacacaaactaaaacttcaagctaaaattctcactctctctctcatctcgagatcatagtatcatattcaatatcatgtcttaccaaacacatggctttggaagctctcaactcaccaacaacaaccgcttcatcttttccctttgacgacccaactattccatgggcgaaacgaaaacgttcaaagcgttctcgcgaccatccttctgaagaagagtacctcgccctctgcct

SEQ ID NO: 3762 - DNA, 286 bp, Glycine max
tttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccgccacagccacagccacagccgacaccagatccttccaccaagctcagttacaaatgctccgtttgcgacaagagcttcccctcttaccaagcgctcggtggacacaaggccagtcaccggaaactcgccgccg

SEQ ID NO: 3763 - DNA, 248 bp, Glycine max
actcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcg

SEQ ID NO: 3764 - DNA, 239 bp, Glycine max
caaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagtt

SEQ ID NO: 3765 - DNA, 268 bp, Glycine max
  unsure (1)..(268): unsure at all n locations
ctcgatcaactcaacacaaaccaaaactnaagctaaaattctcactctctctctcatctcgagatcatagtatcatattcaatatcatttcataccaaacacatggctttggaagctctcaactcaccaacaacaaccgctnccatcttttccctttgacgacccaactattccatgggcgaaacgaaaacgttcaaagcgttctcgngaccatccttctgaagaagagtactcgcctctgcctcatcatgctggccgngggggaaca

SEQ ID NO: 3766 - DNA, 276 bp, Glycine max
caactcgatcaactcaacacaaaccaaaactcaagctaaaattctcactctctctctcatctcgagatcatagtatcatattcaatatcatttcataccaaacacatggctttggaagctctcaactcaccaacaacaacgctccatcttttccctttgacgacccaactattccatgggcgaaacgaaaacgttcaaagcgttctcgcgaccatccttctgaagaagagtacctcgccctctgcctcatcatgctcgctcgcggcggcaccacca

SEQ ID NO: 3767 - DNA, 230 bp, Glycine max
ctcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagta

SEQ ID NO: 3768 - DNA, 270 bp, Glycine max
ccaaaactcaagctaaattctcactctcacaacttcaatctctttctctctctctctctctctctctctctaacaaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcact

SEQ ID NO: 3769 - DNA, 272 bp, Glycine max
ctcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccac

SEQ ID NO: 3770 - DNA, 257 bp, Glycine max
ccaaaactcaagctaaattctcactctcacaacttcaatctctttctctctctctctctctctctctctctaccaaaaaaatggctttggacactctcaactcaccaacaacaaccgccccatctttccccttcgacgacccaactattccatgggccaaaagaacacgttcaaagcgttgttcacgcgaccacccttcggaggaagagtacctcgctctctgcctcatcatgctcgctcgcggcggcaccacccgc

SEQ ID NO: 3771 - DNA, 254 bp, Glycine max
ctcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcgg

SEQ ID NO: 3772 - DNA, 196 bp, Glycine max
ctcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattcaatgggcgaaccgaaacgttccaa

SEQ ID NO: 3773 - DNA, 261 bp, Glycine max
ctctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaag

SEQ ID NO: 3774 - DNA, 391 bp, Glycine max
  unsure (1)..(391): unsure at all n locations
ccaaaactcatgctatattctcactctcacaacttcaatcgctttcgctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttnccctcttaccaagcgctcggtggacacaaggccagtcaccggaaactcgc

SEQ ID NO: 3775 - DNA, 342 bp, Glycine max
caaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaactttccc

SEQ ID NO: 3776 - DNA, 363 bp, Glycine max
ctcgatcaactcaacacaaaccaaaactcaagctaaaatgctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccggcacgtcagcccttcaccggcacagccacagccacagccgacaccagatccttccaccaagctcagttacaaatgc

SEQ ID NO: 3777 - DNA, 281 bp, Glycine max
  unsure (1)..(281): unsure at all n locations
ctctccacacacatatataantccaaacaagtgaacaacactccctcctttgtcccattactagtacatacattcccctaaccaagttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgaccggactcgtcgaacgatacggcccacgaaattggtccctcatcagc

SEQ ID NO: 3778 - DNA, 252 bp, Glycine max
ctagtacatacattcccctaaccaagttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgaccggactcgtcgaacgatacggcccacgaaattggtccctcatcagccgctacattaagggaaggtccggcaagtcat

SEQ ID NO: 3779 - DNA, 258 bp, Glycine max
ccctaaccaagttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgaccggactcgtcgaacgatacggcccacgaaattggtccctcatcagccgctacattaagggaaggtccggcaagtcatgccggctccgatggtgcaatc

SEQ ID NO: 3780 - DNA, 291 bp, Glycine max
tacatacattcccctaaccaagttttaagtttttctcaacagaatggaagcaaccaacagaagctcttcctccacttcctctctcctctgattgctgctcttccgagtccaaccccaacaagcccgacagaatcaaaggcccatggagcgccgaagaggatcggatcctgaccggactcgtcgaacgatacggcccacgaaattggtccctcatcagccgctacattaagggaaggtccggcaagtcatgccggctccgatggtgcaatcagcttagccccgccgtggagc

SEQ ID NO: 3781 - DNA, 273 bp, Glycine max
gtacatacattcccctaaccaagttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgaccggactcgtcgaacgatacggcccacgaaattggtccctcatcagccgctacattaagggaaggtccggcaagtcatgccggctccgatggtgcaatcagc

SEQ ID NO: 3782 - DNA, 234 bp, Glycine max
agtacatacattcccctaatcacgttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgacggactcgtcgaacgatacggcccacgaaattggtccctcatcagccgctacattaagggaa

SEQ ID NO: 3783 - DNA, 264 bp, Glycine max
ccctaaccaagttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgaccggactcgtcgaacgatacggcccacgaaattggtccctcatcagccgctacattaagggaaggtccggcaagtcatgccggctccgatggtgcaatcagctta

SEQ ID NO: 3784 - DNA, 297 bp, Glycine max
caacaaatgaatattctcggacaatcattcaacgaatcaaacaacggaagctactcttgttcgttcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacgtatccagtgcc

SEQ ID NO: 3785 - DNA, 258 bp, Glycine max
caacactctcaacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggaaacaagacacccggtgtaccgaggagtacgaaggaggaacaacaacaagtgggtctgcgaggttcgtgtt

SEQ ID NO: 3786 - DNA, 285 bp, Glycine max
caacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacg

SEQ ID NO: 3787 - DNA, 269 bp, Glycine max
atattctcggacaatcattcaacgaatcaaacaacggaagctactcttgttcgtcgccggagactggtagctcctctaacattccaaacacttttcactccgacgaggaagtgcacacactagcttcggcgcgtcctaacaaacgtgcggggcgtcgaatttttaaggagacaagacacccggtgtaccgaggagtacgaaggaggaacaacaacaagtgggtctgcgaggttcgtgttcccaacgacaagtccaccaggatttggctt

SEQ ID NO: 3788 - DNA, 299 bp, Glycine max
gcatctacaagttgtgcagatagtccagctatatcttgtgtgcaactagaagttgaagatcagcctaagtcacctggaatcaacatgaattctgagccatctgtagttgctgttcctgatcttgatgcatcaaaagaacaaccagtgggaaaagcccctgtgactactggtgttaatgacatattctgggaacgattcttgacagagaatcctggttcatctgaaatgcaggaagcacagtctgaaagaaaggattctgatggcagaagtaatgccaaattttggtggaacattaggaa

SEQ ID NO: 3789 - DNA, 255 bp, Glycine max
atttaaacctggattttgatgcatctacaagttgtgcagatagtccagctatatcttgtgtgcaactagaagttgaagatcagcctaagtcacctggaatcaacatgaattctgagccatctgtagttgtgttcctgatcttgatgcatcaaaagaacaaccagtgggaaaagcccctgtgactactggtgttaatgacatattctgggaacgattcttgacagagaatcctggttcatttgaaatgcaggaagc

SEQ ID NO: 3790 - DNA, 255 bp, Glycine max
  unsure (1)..(255): unsure at all n locations
gctctcttcttccctgcttcacaatttntatttnaatgatactattttgttattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaaccagctctcgccgcangtggcccaccgcccct

SEQ ID NO: 3791 - DNA, 273 bp, Glycine max
  unsure (1)..(273): unsure at all n locations
gctctcttcttccctgcttcacaatttttattttaatgatactattttgttattgttaagacggcatcatcagggaaatggatcgggtgaaggncccatggagcccagaagaggacgaggctttgcggaggctggttcaggcccacgggcctcgaaactggtcggtgataagcaagtccgttccgggacgatccgggaaatcgtgccgcttacggtggtgcaaccagctnctncgccgcagtggcccaccgccccttctcgccggacgaggac

SEQ ID NO: 3792 - DNA, 263 bp, Glycine max
caccaccacctcgctctcttcttccctgcttcacaatttttattttaatgatactattttgttattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaacagctctcgccgcaggtggcccaccgcc

SEQ ID NO: 3793 - DNA, 256 bp, Glycine max
atggagcccagaagaggacgaggccctgcgggcgctggttcaggcccacgggcctcgaaactggtcggtgataagcaagtccattccggggagatccgggaaatcgtgccgcttacggtggtgcaaccagctctcgccgcaggtagcccatcgccccttctcgcaggaggaggacgaggccatcatcatggcccacgccaagttcggcaacaagtgggccaccatagctcgcctgctcaacggccgcaccgataac

SEQ ID NO: 3794 - DNA, 263 bp, Glycine max
ccaccaccacctcgctctcttcttccctgcttcacaatttttattttaatgatactattttgttattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaaccagctctcgccgcaggtggcccaccg

SEQ ID NO: 3795 - DNA, 277 bp, Glycine max
  unsure (1)..(277): unsure at all n locations
cctcgctctcttcttccctgcttcacaatttttattttaatgatactattttgttattgttaagnccggcatcatcaggggaatgnatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaaccagctctcgccgcantggcccaccgccccttctcgccggacgaggacg

SEQ ID NO: 3796 - DNA, 290 bp, Glycine max
cctcgctctcttcttccctgcttcacaatttttattttaatgatactattttgttattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtggcaccagctctcgccgcaggtggcccaccgccccttctcgccggacgaggacgaggccatcgtcag

SEQ ID NO: 3797 - DNA, 268 bp, Glycine max
ccaccacctcgctctcttcttccctgcttcacaatttttattttaatgatactattttgttattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaaccagctctcgccgcaggtggcccaccgccccttct

SEQ ID NO: 3798 - DNA, 251 bp, Glycine max
accaccaccacctcgctctcttcttccctgcttcacaatttttattttaatgatactattttgttattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaacagctctcgccgca

SEQ ID NO: 3799 - DNA, 274 bp, Glycine max
gaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagacgcgc

SEQ ID NO: 3800 - DNA, 231 bp, Glycine max
ttcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataa

SEQ ID NO: 3801 - DNA, 277 bp, Glycine max
aagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgttcggagttcatcagcttcataacgggtgaggcgtcggacaagtgccagagggagaagcgc

SEQ ID NO: 3802 - DNA, 263 bp, Glycine max
gaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaatgcgacggtgcaggaatgcgtgtcggagtcatcagcttcataacgggtgaggcgtcggacaagtgcca

SEQ ID NO: 3803 - DNA, 264 bp, Glycine max
gaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagtcatcagcttcataacgggtgaggcgtcggacaagtgccag

SEQ ID NO: 3804 - DNA, 259 bp, Glycine max
  unsure (1)..(259): unsure at all n locations
ctttattctctcacacaaaataatgctgcagaagcttggcaacacgtctcatgatcctgaantgagaaagggcccatggacaatggaagaagacttaatcttgatcacctatattgccaatcacggggaaggggtttggaactctttggccaaggctgctggacttaaacgtaccggaaagagttgccggctccggtggctaaactacctccgtcctgatgttagaagagggaatattacacccgagaacagcttttga

SEQ ID NO: 3805 - DNA, 249 bp, Glycine max
ctttattctctcacacaaaataatggacaagaagcttggcaacacgtctcatgatcctgaagtgagaaaggggccatggacaatggaagaagacttaatcttgatcacctatattgccaatcacggggaaggggtttggaactctttggccaaggctgctggacttaaacgtaccggaaagagttgccggctccggtggctaaactacctccgtcctgatgttagaagagggaatattcacccgaggaa

SEQ ID NO: 3806 - DNA, 261 bp, Glycine max
ctttattctctcacacaaaataatggacaagaagcttggcaacacgtctcatgatcctgaagtgagaaaggggccatggacaatggaagaagacttaatcttgatcacctatattgccaatcacggggaagggtttggaactctttggccaaggctgctggacttaaacgtaccggaaagagttgccggctccggtggctaaactacctccgtcctgatgttagaagagggaatattacacccgaggaacagcttttgatc

SEQ ID NO: 3807 - DNA, 232 bp, Glycine max
ctttattctctcacacaaaataatggacacagaagcttggcaacacgtctcatgatcctgaagtgagaaaggggccatggacaatggaagaagacttaatcttgatcacctatattgccaatcacggggaaggggtttggaactctttggccaaggctgctggacttaaacgtaccggaaagagttgccggctccggtggctaaactacctccgtcctgatgttagaagagg

SEQ ID NO: 3808 - DNA, 235 bp, Glycine max
tctccacaaaataatggacaagaagcttggcaacacgtctcatgatcctgaagtgagaaaggggccatggacaatggaagaagacttaatcttgatcacctatattgccaatcacggggaaggggtttggaactctttggccaaggctgctggacttaaacgtaccggaaagagttgccggctccggtggctaaactacctccgtcctgatgttagaagagggaatattacaccc

SEQ ID NO: 3809 - DNA, 267 bp, Glycine max
attctctcacacaaaataatagacaagaagcttggcaacacgtctcatgatcctgaagtgagaaaggggccatggacaatggaagaagacttaatcttgatcacctatattgccaatcacggggaaggggtttggaactctttggccaaggctgctggacttaaacgtaccggaaagagttgccggctccggtggctaaactacctccgtcctgatgttagaagagggaatattacacccgaggaacagcttttgatcatggaactt

SEQ ID NO: 3810 - DNA, 392 bp, Glycine max
ctttctctttattctctcacacaaaataatggacaagaagcttggcaacacgtctcatgatcctgaagtgagaaaggggccatggacaatggaagaagacttaatcttgatcacctatattgccaatcacggggaaggggtttggaactctttggccaaggctgctggacttaaacgtaccggaaagagttgccggctccggtggctaaactacctccgtcctgatgttagaagagggaatattacacccgaggaacagcttttgatcatggaacttcatgcagagtggggaaacaggtggtccaaaattgccaagcatctacccggaaggactgatactgagattaagaactactggaggacaatgatccagatgcacctcaagcaagctt

SEQ ID NO: 3811 - DNA, 286 bp, Glycine max
aggaaagttcctgagccttcttgaacaacccggtcctccccttcgagaacatgacttgtctgctgttggcattgttgattcttttgatctcgatcttccctcgacccattggcttaatttctcgctctctcagagcacaaacatgcccaactgaacgagaaattagagctggtgttttgggaggagtagcaattcgacggttgaagatgcgaaggaaggcaccacactaagtaaggttgcggaaatggaaagcgttttacctcaaatgaccagagaggttggctgg

SEQ ID NO: 3812 - DNA, 247 bp, Glycine max
tcctcccatggagtctatggaaagttcctgagccttcttgaacaacccggtcctccccttcgagaacatgacttgtctgctgttggcattgttgattcttttgatctcgatcttccctcgacccattggcttaatttctcgctctctcagagcacaaacatgcccaactgaacgagaaattagagctggtgttttcggaggagtagcaattcgccggttgcagatgcgaaggacggcaccacactaa

SEQ ID NO: 3813 - DNA, 247 bp, Glycine max
ggtttttccagagttgtctttgaagtcctaaaacttgctgcacaaaataacaaactatttcgggtcttctgcacagagggaagaccagaccgaacaggtttgcggttgtcgaatgagctggccaaacttgatgtttcagtgaaacttctaatagattctgctgttgcatatactatggatgaggtggacatggtttttgtgggtgcggatggagttgtcgaaagtgggggcataatcaacatgatgg

SEQ ID NO: 3814 - DNA, 237 bp, Glycine max
ggtttttccagagttgtctttgaagtcctaaaacttgctgcacaaaataacaaactatttcgggtcttctgcacagagggaagaccagaccgaacaggtttgcggttgtcgaatgagctggccaaacttgatgtttcagtgaaacttctaatagattctgctgttgcatatactatggatgaggtggacatggtttttgtgggtgcggatggagttgtcgaaagtgggggcataatc

SEQ ID NO: 3815 - DNA, 262 bp, Glycine max
attttgtttgaataagatataaggcaatagtaatattagtattgttgataataattaggtagaaaaaatattatggggaggggaagagtggaactgaaaaggatagagaacaagataaacaggcaggtaacgtttgcaaagaggagaaatgggcttctcaagaaagcctatgagctttctgttctctgtgatgctgaggttgccctcatcatcttctccacccgtggcaagctttatgaattctgcagcaccaacagcatgc

SEQ ID NO: 3816 - DNA, 266 bp, Glycine max
ataagatataaggcaatagtaatattagtattgttgataataattaggtagaaaaaatattatggggaggggaagagtggaactgaaaaggatagagaacaagataaacaggcaggtaacgtttgcaaagaggagaaatgggcttctcaagaaagcctatgagctttctgttctctgtgatgctgaggttgccctcatcatcttctccacccgtggcaagctttatgaattctgcagcaccaacagcatgctcaaaacacttgaaa

SEQ ID NO: 3817 - DNA, 256 bp, Glycine max
  unsure (1)..(256): unsure at all n locations
gaaaggggtaggtgttgtacagaaatagaaattaaaaaattgagtgaaaaattaaaagncgaaatttttttagaagaagagtgatagggatatggggaggggaagagtggagttgaagaggatagagaacaagataaacaggcaagtcacttttgcaaagaggagaaangggcttctcaagaaagcctatgagctatcctgttctctgtgatgctgaggttgccctcatcatcttctccaaccgaggcaagcttta

SEQ ID NO: 3818 - DNA, 262 bp, Glycine max
tacggctgcgagaagacgacagaagggggatagggatatggggaggggaagagtggagttgaagaggatagagaacaagataaacaggcaagtcacttttgcaaagaggagaaatgggcttctcaagaaagcctatgagctatctgttctctgtgatgctgaggttgccctcatcatcttctccaaccgaggcaagctttatgagttctgtagcagctctagcatgctcaaaacacttgaaaggtaccagaaatgcagctat

SEQ ID NO: 3819 - DNA, 162 bp, Glycine max
actcgagccgaatcggctcgagtacggctgcgagaagacgacagaaggggagagatatgggtacgggaagagtggagtggaagaggatagagaacaagataaacaggcaagttacgtttgcaaagaggagaaatgggcttcctcagaaagcctatgagctat

SEQ ID NO: 3820 - DNA, 269 bp, Glycine max
gctgcgagaagacgacagaaggggaggtgtagaaatattatggggaggggaagagtggaactcaaaaggatagagaacaagataaacaggcaggtaacgtttgcaaagaggagaaatgggcttctcaagaaagcctatgagctttctgttctctgtgatgctgaggttgccctcatcatcttctctacccgcggcaagctttatgaattctgtagcaccaacagcatgctcaaaacacttgaaaggtaccaaaagtgcagctatggtgc

SEQ ID NO: 3821 - DNA, 237 bp, Glycine max
ggataataattaggtagaaaaaatactatggggaggggaagagtggaactgaaaaggatagagaacaagataaacaggcaggtaacgtttgcaaagaggagaaatgggcttctcaagaaagcctatgagctttctgttctctgtgatgctgaggttgcactcatcatcttctccacccgtggcaagctttataaattctgcagcaccaacagcatgctcaaaacacttgaaaggtac

SEQ ID NO: 3822 - DNA, 251 bp, Glycine max
gtgaagtgtgtgatgcactctatccttctttctcttgaacccataattccatgactcggcgttgctcccactgcagcaacaacggccacaattcccggacatgcccttcgcgtgggggcggaggtgtgaagcttttcggggtcaggctgacggatggatcaatcagtaagaagagcgccacatgggcaacctaaacctctcctccgccgccgcacatcaccaattccattcatctccttcttcttccaacc

SEQ ID NO: 3823 - DNA, 272 bp, Glycine max
ggatattctgaaatcccatccaatcgaaggctgtgaagtgtgtgatgcactctatccttctttctcttgaacccataattccatgactcggcgttgctcccactgcagcaacaacggccacaattcccggacatgcccttcgcgtgggggcggaggtgtgaagcttttcggggtcaggctgacggatggatcaatcattaagaagagcgccagcatgggcaacctaaacctctcctccgccgccgcacatcaccaattccattcatctcctt

SEQ ID NO: 3824 - DNA, 270 bp, Glycine max
cttctgaaatcccatccaatcgaaggctgtgaagtgtgtgatgcactctatccttctttctcttgaacccataattccatgactcggcgttgctcccactgcagcaacaacggccacaattcccggacatgcccttcgcgtgggggcggaggtgtgaagcttttcggggtcaggctgacggatggatcaatcattaagaagagcgccacatgggcaacctaaacctctcctccgccgccgcacatcaccaattccattcatctccttctt

SEQ ID NO: 3825 - DNA, 282 bp, Glycine max
cttctttctcttgaacccataattccatgactcggcgttgctcccactgcagcaacaacggccacaattccgtggcatgcccttcgcgtgggggcggatgtgtgaagcttttcggggtcaggctgacggatggatcaatcattaagaagagcgccagcatgggcaacctaaacctctcctccgccgccgcacatcaccaattccattcatctccttcttcttccaacctcgccgccgccccctcatcccccaatccaagctccccatgctccgaccctcccc

SEQ ID NO: 3826 - DNA, 403 bp, Glycine max
gcggtgaagtgtgtgatgcactctatccttctttctcttgaacccataattccatgactcggggtgggtcccactgcagcaacaacggccacaattcccggacatgcccttcgcgtgggggcggatgtgtgaagcttttcggggtcaggctgacggatggatcaatcattaagaagagcgccagcatgggcaacctaaacctctactccgccggcgcacatcaccaattccattcatatgcttcttcttccaacctcgccggcgacccctcatcccccaatccaagctccccatgctacgacccttcccaaggttacttgatcgatgaccccgcccatgtctacaccttcgctaaccgccgcagtgatagaaaaaaaggtgttccatggactggaaaagaaca

SEQ ID NO: 3827 - DNA, 255 bp, Glycine max
gatttcttgcttcttttttttctcctttctgatcactaccatggctagaaagaagttgaatcttacatacatacccaatgactcaaagaggaagacaacattgaagaaaagaaagaatggtttgatgaagaagatgaatgaaattagcactctttgtgggattgaaacatgtgctataatctatagtccaaatgatcctcagccagaggtttggccatctgactctggagtccaaagggtgctttcaaggttcat

SEQ ID NO: 3828 - DNA, 259 bp, Glycine max
gttttcttgcttattcttcttttctcctttctgatcactaccatggctagaaagaagctgaatcttacatacataaccaatgacccgaagaggaagacaacattgaagaaaagaaagaatggtttgatgaagaagatgaatgaaattagcactctttgtgggattgaatcatgtgctataatatatagtccaaatgatcctcagccagaggtttggccatctgactcaggagtccaaagggtgctttccaggttcatgg

SEQ ID NO: 3829 - DNA, 194 bp, Glycine max
aatacatagaatatgtatgtacaatatatattatattatattatatataataaaataagagactctgaagtctgaacacggtgctcacataatgttgaggagttttagcatgccctgcaatggaggctgtcaaggatttgtataacagtattttgggtatatttctttcataatttattttgcgatggtatgtg

SEQ ID NO: 3830 - DNA, 223 bp, Glycine max
tataaaataagagactctgaagtctgaacacggtgctcacataatgttgaggagttttagcatgccctgcaatggaggctgtcaaggatttgtataacagtattttgggtatatttcttttcataatttattttgcgattgttatgtgaaaatgttgtatgtgtttaacttggatgtacatgttacgttattagtggtctatgtgatgttcatttaagacttg

SEQ ID NO: 3831 - DNA, 275 bp, Glycine max
acacaaagtaatggacaaaaaaccatgcaactcatcatctcatgatcctgaagtgagaaagggaccatggaccatggaagaagacttgatcttgataaactatattgcaaatcacggtgaaggtgtttggaactccttagccaaagcttctggtctcaaacgaacgggaaagagttgtcgactccgttggctaaactaccttcgtcctgatgttagaagaggaaacattacacccgaggaacagcttttgatcatagaacttcatgcaaagtggg

SEQ ID NO: 3832 - DNA, 253 bp, Glycine max
gcacacaaagtaatggacaaaaaaccatgcaactcatcatctcatgatcctgaagtgagaaagggaccatggaccatggaagaagacttgatcttgataaactatattgcaaatcacggtgaaggtgtttggaactccttagccaaagcttctggtctcaaacgaacgggaaagagttgtcgactccgttggctaaactaccttcgtcctgatgttagaagaggaaacattacacccgaggaacagcttttga

SEQ ID NO: 3833 - DNA, 244 bp, Glycine max
cgtgcacacaaaataatggacaaaaaaccatgcgactcatctcatgatccagaagtgagaaagggaccatggatcatggaagaagacttgatcttgataaactatattgcaaatcacggtgaaggtgtttggattctttagccaaagcttctggtcttaaacgaacgggaaagagttgtcgactccgttggctaaactaccttcgtcctgatgttagaagaggaaacattacacccgaagaaca

SEQ ID NO: 3834 - DNA, 241 bp, Glycine max
ctctagcgtgcacacaaaataatggacaaaaaaccatgcgactcatctcatgatccagaagtgagaaagggaccatggatcatggaagaagacttgatcttgataaactatattgcaaatcacggtgaaggtgtttggaattctttagccaaagcttctggtcttaaacgaacgggaaagagttgtcgactccgttggctaaactaccttcgtcctgatgttagaagaggaaacattacac

SEQ ID NO: 3835 - DNA, 259 bp, Glycine max
aacatgcacacaaagtaatggacaaaaaaccatgcaactcatcatctcatgatcctgaagtgagaaagggaccatggaccatggaagaagacttgatcttgataaactatattgcaaatcacggtgaaggtgtttggaactccttagccaaagcttctggtctcaaacgaacgggaaagagttgtcgactccgttggctaaactaccttcgtcctgatgttagaagaggaaacattacacccgaggaacagcttttgat

SEQ ID NO: 3836 - DNA, 250 bp, Glycine max
cggctcgagcggctcgagctcgagcgaatcggctcgagggatcgaggtaatggacaaaaaaccatgcacttcatgctctcatgatcctgaagtgagaaagggaccatggaccatggaagaagacttgatcttgataaactatattgcaaatcacggtgaaggtgtttggaactccttagccaaagcttctggtctcaaacgaacgggaaagagttgtcgactccgttggctaaactaccttcgtcctgat

SEQ ID NO: 3837 - DNA, 276 bp, Glycine max
gtttgatacaggagcatatgttggtggaagcaaacagatctttgaccatgaagctggaagaaatcaattcaagaaaccagtataggcaaacatgggaagctggtgagcaaagtatgccatatggaacccaaaatgctcactctcaaggcttcttccagcctttggagtgcaaccccacattgcagataggttctgactacaggtacatccctgaagcctcagagcagcagctagctgccacaactcaagctcaacaagtcaatggatttattcctg

SEQ ID NO: 3838 - DNA, 256 bp, Glycine max
ctcttaagcaagtgaggtcaacaaagactcagttcatgctggaccagttagctgatcttcagaataaggagcatatgttggtggaagcaaacagatctttgaccatgaagctggaagaaatcaattcaagaaaccagtataggcaaacatgggaagctggtgagcaaagtatgccatatggaacccaaaatgctcactctcaaggcttcttccagcctttggagtgcaacccacattgcagataggttctgactac

SEQ ID NO: 3839 - DNA, 281 bp, Glycine max
gagcggcaactggattcatctctcaagcaagtgaggtccacaaagactcagttcatgctggaccagttagctgatcttcagaataaggagcatatgctggtagaagcaaacagatctttgaccatgaagctggaagaaatcaattcaagaaaccagtataggcaaacatgggaagctggtgagcaaagtatgtcatatggtacacaaaatgctcactcccaaggctttttccagcctttggagtgcaaccccacattgcagataggttctgactacaggta

SEQ ID NO: 3840 - DNA, 241 bp, Glycine max
ggagaaggttctagaatggtcagggaactttttgttatggccagggaacatgctccatcaattatcttcatggacgaaattgacagtattggatctgctcggatggaatctggaagtggcaatggtgatagtgaggtacagcgtactatgctggaacttctcaatcagttggatggatttgaagcttcaaacaagatcaaggttttgatggccacaaatcggattgatatcctggatcaag

SEQ ID NO: 3841 - DNA, 245 bp, Glycine max
gcagtggctcatcatactgactgtacattcatcagggtgtctggttctgaattagttcagaaatacattggagaaggttctagaatggtcagggaactttttgttatggccagggaacatgctccatcaattatcttcatggacgaaattgacagtattggatctgctcggatggaatctggaagtggcaatggtgatagtgaggtacagcgtactatgctggaacttctcaatcagttggatgg

SEQ ID NO: 3842 - DNA, 275 bp, Glycine max
gcaatggtgatagtgaggtacagcgtactatgctggaacttctcaatcagttggatggatttgaagcttcaaacaagatcaaggttttgatggccacaaatcggattgatatcctggatcaagccctccttagacctggacggattgaccggaagattgaatttccaaaccctaatgaagagtctcggctggatattttgaaaatccattcaagaagaatgaatttaatgcgtggcattgatctgaagaagattgccgagaagatgaatggagca

SEQ ID NO: 3843 - DNA, 282 bp, Glycine max
attcggctcgaggttgccgattctagttacgacatgattagtggtttagaccaggaaattaaggaaataaaagagggcattgaatttaccaatccaacatcctgagctgtttggaagtcttggaattgcacaaccaaagggtgtcctggtctatgggccacctggtacaggaacaacattgttggctaggggagtgcgtcatcatactgactgtacattcatcagggtgtctggttctgaattagttcagaaatacattggagaaggttctagaatggtcag

SEQ ID NO: 3844 - DNA, 247 bp, Glycine max
gttgatccattggtcaatctgatgaaagttgagaaagttcccgattctacatatgacatgattggtggtttagaccagcaaattaaagaaataaaagaggtcattgagctaccaatcaaacatcctgagctgtttgaaagtcttggaattgcacaaccaaagggtgtcctgctctatgggccacctggtacaggtaaaacattgttggctagggcagtggctcatcatactgactgtacattcatca

SEQ ID NO: 3845 - DNA, 283 bp, Glycine max
ctagaatggtcagggaactttttgttatggccagggaacatgctccatcaattatcttcatggacgaaattgacagtattggatctgctcggatggaatctggaagtggcaatggtgatagtgaggtacagcgtactatgctggaacttctcaatcagttggatggatttgaagcttcaaacaagatcaaggttttgatggccacaaatcggattgatatcctggatcaagccctccttagacctggacggattgaccggaagattgaatttcctaaccctaa

SEQ ID NO: 3846 - DNA, 260 bp, Glycine max
cagaaatataagaggtcattgagttaccaatcaaacatcctgagctgtttgacagtcttggaattgcacaaccacagggtgtcctgctctatgggccacctggtacaggaaaaacattgttggctagggcagtgctcatcatactgactgtacattcatcagggtgtctggttctgaattagttcagaaatacattggagaaggttctagaatggtcagggaactttttgttatggccagggaacatgctccatcaatta

SEQ ID NO: 3847 - DNA, 205 bp, Glycine max
gcctccttagacctggacggattgaccggaagattgaatttccaaaccctaatgaagagtctcggctggatattttgaaaatccattcaagaagaatgaatttaatgcgtggcattgatctgaagaagattgccgagaagatgaatggagcatctggtgctgaacttaaggctgtttgcaccgatgctggaatgtttgcattgag

SEQ ID NO: 3848 - DNA, 265 bp, Glycine max
gccctccttagacctggacggattgaccggaagattgaatttccaaaccctaatgaagaatctcggctggatattttgaaaatccattcaagaagaatgaatttaatgcgtggcattgatctgaagaagattgccgagaagatgaatggagcatctggtgctgaacttaaggctgtttgcaccgaagctggaatgtttgcattgagggagcggagggtacacgtgactcaggaggattttgagatggctgtggccaaggtgatga

SEQ ID NO: 3849 - DNA, 278 bp, Glycine max
atctgctcggatggaatctggaagtggcaatggtgatagtgaggtacagcgtactatgctggaacttctcaatcagttggatggatttgaagcttcaaacaagatcaaggttttgatggccacaaatcggattgatatcctggatcaagccctccttagacctggacggattgaccggaagattgaatttccaaaccctaatgaagagtctcggctggatattttgaaaatccattcaagaagaatgaatttaatgcgtggcattgatctgaagaaga

SEQ ID NO: 3850 - DNA, 271 bp, Glycine max
gttctgccaagtaaagttgatccattggtcaatctgatgaaagttgagaaagttcccgattctacatatgacatgattggtggtttagaccagcaaattaaagaaataaaagaggtcattgagctaccaatcaaacatcctgagctgtttgaaagtcttggaattgcacaaccaaagggtgtcctgctctatgggccacctggtacaggtaaaacattgttggctagggcagtggctcatcatactgactgtacattcatcagggtgtctg

SEQ ID NO: 3851 - DNA, 277 bp, Glycine max
agttctgccaagtaaagttgatccattggtcaatctgatgaaagttgagaaggttcccgattctacttacgacatgattggtggtttagaccagcaaattaaagaaataaaagaggtcattgagttaccaatcaaacatcctgagcggtttgaaagtcttggaattgcacaaccaaagggtgtcctgctctatgggccacctggtacaggaaaaacattgttggctagggcagtggctcatcatactgactgtacattcatcagggtgtctggttct

SEQ ID NO: 3852 - DNA, 441 bp, Glycine max
  unsure (1)..(441): unsure at all n locations
atacggctgcgagaagacgacagaaggggggtgtctggttctgaattagttcagaactacattggagaaggttctagaatggtcagggaactttttgttatggccagggaacatgctccatcaattatcttcatggacgaaattgacagtattggatctgctcggatggaatctggaagtggcaatggtgatagtgaggtacagcgtactatgctggaacttctcaatcagttggatggatttgaagcttcaaacacgatcaaggttttgatggccataaatcggattgatatcctggatcaagcnctccttagacctggacggattgaccggaagattgaatttccaaaccctaatgaacagtctcggctggatattttgatcatccattcatgaagaatgaatttaatgcgtggcattgatctgaagaagattgccgag

SEQ ID NO: 3853 - DNA, 356 bp, Glycine max
ctgagctgtttgaaagtcttggaattgcacaaccaaggggtgtcctgctctatgggccacctggtacaggaaaaacattgttggctagggcagtggctcatcatactgactgtacattcatcagggtgtctggttctgaattagttcagaaatacattggagaaggttctagaatggtcagggaactttttgttatggccagggaacatgctccatcaattatcttcatggacgaaattgacagtattggatctgctcggatggaatctggaagtggcaatggtgatagtgaggtacagcgtactatgctggaacttctcaatcagctggatggatttgaagcttctaacaagatc

We claim:

1. An isolated transcription factor, wherein said transcription factor is encoded by a nucleic acid molecule comprising a nucleic acid sequence having the nucleic acid sequence of SEQ ID NO: 1 or the complete complement thereof.

2. A recombinant nucleic acid construct encoding the isolated transcription factor of claim 1.

3. A substantially purified nucleic acid molecule comprising a nucleic acid sequence having the nucleic acid sequence of SEQ ID NO: 1 or the complete complement thereof.

4. A recombinant nucleic acid construct comprising the substantially purified nucleic acid molecule of claim 3.

5. A substantially purified nucleic acid molecule, wherein said nucleic acid molecule comprises a nucleic acid sequence that shares between 100% and 90% sequence identity with SEQ ID NO: 1 or the complete complement thereof.

6. The substantially purified nucleic acid molecule of claim 5, wherein said nucleic acid sequence shares between 100% and 95% sequence identity with SEQ ID NO: 1 or the complete complement thereof.

7. The substantially purified nucleic acid molecule of claim 6, wherein said nucleic acid sequence shares between 100% and 98% sequence identity with SEQ ID NO: 1 or the complete complement thereof.

8. The substantially purified nucleic acid molecule of claim 7, wherein said nucleic acid sequence shares between 100% and 99% sequence identity with SEQ ID NO: 1 or the complete complement thereof.

9. A transformed plant comprising a nucleic acid molecule which comprises:
   (a) an exogenous promoter region which functions in a plant cell to cause the production of an mRNA molecule; which is linked to;
   (b) a nucleic acid molecule, wherein said nucleic acid molecule comprises a nucleic acid sequence that shares between 100% and 90% sequence identity with SEQ ID NO: 1 or the complete complement thereof, which is linked to
   (c) a 3' non-translated sequence that functions in said plant cell to cause the termination of transcription and the addition of polyadenylated ribonucleotides to said 3' end of said mRNA molecule.

10. A transformed seed comprising a transformed plant cell comprising a nucleic acid molecule which comprises:
   (a) an exogenous promoter region which functions in said plant cell to cause the production of an mRNA molecule; which is linked to;
   (b) a nucleic acid molecule, wherein said nucleic acid molecule comprises a nucleic acid sequence that shares between 100% and 90% sequence identity with SEQ ID NO: 1 or the complete complement thereof, which is linked to
   (c) a 3' non-translated sequence that functions in said plant cell to cause the termination of transcription and the addition of polyadenylated ribonucleotides to said 3' end of said mRNA molecule.

\* \* \* \* \*